United States Patent 10,167,482 (GENES AND USES FOR PLANT ENHANCEMENT) - sequence listing, part 16

SEQ ID NO: 67354 - protein, 622 aa, Synechococcus elongatus PCC 6301
MIAMHGVPIARRLMTEDGSLVYDPEAIARYYLNRPFAVWSRFLEILWPLFSFIFGLWFDARTGASRRNQNQRAVQLRDLLTELGPAFIKVGQALSTRPDLVPPAYLEELTRLQDQLPAFPNAIAFEFIEAELGVPPEAIFAELSDNPVSAASLGQVYRGRLHTGEEVAVKVQRPGLAERIALDLYILRGLAAWAMRNVRRVKSNLVAIADEFGLRIFEELDYRQEADNAERFAELYGQLPDIYVPSIYRQYTSRRVLTMEWIQGTKLTELQAIRNQGIDPAYLIERGVQCSLRQLLEYGFFHADPHPGNLLATPDGQLAYLDFGMMSQVEDYQRYGLIEAVVHLVNRDFQGLARDYVKLEFLTPDTDLTPIIPALAGVFKDAMGASVADLNFKSITDQLSQVMYDYPFRVPAYYALIIRSLVTLEGIAINVDPNFKVLSKAYPFIARQILTDPSPDLRASLRELLFNGGQLRWNRLENLLRNASNSSDYDSEHLIQQTVDFLLSESGQDLRDRLVEELVNSLDRLGRGALPLLRNQIRQRLGMDPEPDSTLTDLQPLLRVLSLLQQGQRFEPQRFIPLIPVLGRPEVQQMGQQVVTGLAQKALVRFIREVVVGDRRNNAIAA

SEQ ID NO: 67355 - protein, 639 aa, Thiobacillus denitrificans ATCC 25259
MCGITGIFDTSGVNAISRDLLQRMNETQHHRGPDEGGLHLEPGLGLGHRRLSIIDLSSGQQPLANEDGSVVVVFNGEIYNFQELVPELEALGHVFRTHSDTEVIVHAWEAWGEACVARFRGMFAFVLWDRNQETLFVVRDRFGVKPLYYAFLDTGEFIFGSELKSLMVHPSLGREVDPLAVEDYFAYGYVPEPRTIFKRVHKLPPGFTLTLKRGAPRALPKQYWDMPFAPVAVKDEAGAMDELVERMKESIRLRMIADVPLGAFLSGGVDSSAVVAMMATQSSTPVNTCSIGFDDPAFNEIEYAQQVADRYHTRHHVETVAADDFSLVGKLAQVYDEPYADSSALPTYRVCELARKHVKVALSGDGGDEHFAGYRRYRWFRYEERMRSIIPLGLRRPLFGTLGLLYPKADWAPKMFRAKTTFEALARDTVEGYFHGVSLLSNAQRAQLFSPAFRRELQGYQAVDVLRRHAAVAPTDDPLSLVQYLDMKTYLVGDILTKVDRASMAHALEVREPLLDHELMGWVSGLPVDLKLRGSEGKYLLKKAMEPYLPHDVLYRKKMGFSVPLAAWFRGPLAATIRTVVLGERLAGTGMFNCEFLREVVEAHQSGRRDFSVILWTVLMFDAFLGQVLGLDDTAREAA

SEQ ID NO: 67356 - protein, 229 aa, Paracoccidioides brasiliensis
MASSKAVSRLIAYRRPALLQISPQSSTHLRSTPAFSFSTSSPVSATPAGPPRQGFRLPPPKAWDQGDESALDKAGKYFLMTEMLRGMYVVLEQFFRPPYTIFYPFEKGPISPRFRGEHALRRYPSGEERCIACKLCEAICPAQAITIEAEEREDGSRRTTRYDIDMTKCIYCGFCQESCPVDAIVESPNAEYATETREELLYNKEKLLANGDKWEPELAAAARADAPYR

SEQ ID NO: 67357 - protein, 469 aa, Aspergillus oryzae
MDTLKATLLKSWSRLASILGNPSQKAPLCRLNHFRNTEEPDLYTTGGFHRVSLGDTFDHGRYAILRKLGYGQYSTVWLAQDFKHKKYVTLKLLRADCYGGPHDIFEREILSKISDMSRNSTHDGARHILPLIGDFTHTGPNGDHVCLVFDVLGHHLDFQCAKYEDGRLPVRAVKLIARQLLLGLDFLHRECGVIHTGMGIVSNTFVLYFLTGRIFPIDLKPTNILLELENPDRVISRYLEKVPPLMDTQGNAEVPLREVITTPLISEMEAPRIRIIDFGVASWRDNHLSEQIQSSALRAPEVTIGAPWDTGVDIWSLGCLIMELVQGIVPFSGEASERGTWTAEDDRLARTIEILGPFPLELLRKGSRTPDLFDEKGDLLRIPNMKSTSLERLLNGTTKPFLKPDDMPDAEVPIFINFLRACLRLILSTGVQRQSCFSMNGSDHDAIEWLKVERIEGSYETMHTSIRTQ

SEQ ID NO: 67358 - protein, 606 aa, Thiobacillus denitrificans ATCC 25259
MDGIFGWLGADGAHQDLIRQIAGGDADAAGLRRYHSAELGLAAQSRFGKADIAVEDGHAVALMGRPRFVDADLARVARETGPAAAVAQGWRSHGAGLPARMQGNFAFAVLEPQAKKACLVLDRMGAERLGYAHRGDQLVFGSSVQHVAAHPAVGRNIEPQAIYDYLYFHNIPAPRSLYRGVHKLLPGQIVTLENGRLATRFYWHADYTPHDAGFDVQRDAFRRVLDAAVRDADGPATAAFLSGGTDSSTVVGALTAARGGPVDTFSIGFDAEGFDEMAYARCAAARYDSRRHEYYLKPADIVTAIPLIAREYDEPFGNDSAVPTYFCARAAREAGFGRMLAGDGGDEIFGGNARYAKQKLFENYFRVPAPLRHGLIEPLATLPGVSDHFPLSKLKSYVRQANMGLPLRMESYNFLHRTPLDQIFAADFVAAVDPSAADAALTEVYARTASDHYINRMMHLDLKFTLADNDLRKVGTMTEAAGVEVAYPLLDDRLVALANHLPVDWKVRGQALRWFFKEALRDLLPEEIINKRKHGFGLPFGVWSTQHAPLAELVHDSLSDFKRRGWVQPGYLDHMLAMQRGPHASYYGVMIWVVMMLERWLQANAH

SEQ ID NO: 67359 - protein, 318 aa, Prochlorococcus marinus subsp. pastoris str. CCMP1986
MNDLNIEFPLDDFEELISQIGWSSLDEWFIFWNLKKEMLSINNFWDDNVKDDWIWGLALPLLSQAYKLNKKSPDRKIIGISALPGTGKTTLGKWLESISLKLKFKLSVISIDDFYLPSEEMEFAIKNNPWNVSRGFPGSHSIDLMKEKLLKWKTDGQLNVPVFDKSLRKGLGDRAHWREESPDLLIIEGWFLGVKPLSIDLDNSEKFSPPLSVFESSYRNKIQNNLDQYLDIWNMIDQIWHLKPLKFEYLNEWKSNQEKSMHFKSGSSLKGDNLSNFLRMLNVSIPHKSFDDINSDVLLMINQERKLVRVGLNQQISK

SEQ ID NO: 67360 - protein, 339 aa, Bacillus cereus G9241
MTKIFILASTLSLSFFSGLNIGNAATENFSPVTNAIVQNNDYFAEGNSKDNNKPPGNGGSQDDSGSGGNGSGGNGSGGSGSGGSGSGGNDSGGNGSGGNDSGGNGSGGNGSGGNGSDGSGSGGNGSGGNGSGGNGSGGNGSDGSGSGGNGSGGNGSGGNGSSGNGSGGNGSSGNGSDGSGSGGNGSGGNGSGGNGSGGNGSGGNGSDGNGSGGNSSDGNGSGGNSSDGSGSGGNGSGGNGSGGNGSGGNSSGGNGSGGNRRKGDSSSQGGNDSHGGNRVKGNSSSQGGNGSQGGNVKDNAKKQGDKLPNTATHYPASILMGLSTFLIGMLLFIRRKNAK

SEQ ID NO: 67361 - protein, 362 aa, Bacillus clausii KSM-K16
MNDSIPKKMKAVVAYGPKDYRLEEVDVPVIEHDKEIIVKVEATGICAGDIKAFDGAPSFWGDDTQPAYIKAPMIPGHEFIGHVVAKGDGVGDFEIGDRIISEQIVPCWECRFCNRGQYWMCEKHDLYGFQNNVNGSMAEYMKFTKEAINYKVPADLPIEQAILIEPYACSMHAVQRARIELGDIVVLSGAGTLGLGMIGAVKKSGAKTLVVLDLKDERLALAQQFGADVVLNPAKDNVVEKVKDMTDGYGCDVYIEATGHPASVEQGLSMIRKLGRFVEFSVFKDPVTVDWSIISDRKELDVLGSHLGPYCYPLVIEGIANGDLPTEGVVTHELPLERFAEGFELMKNGSNSLKIILKPQQA

SEQ ID NO: 67362 - protein, 341 aa, Escherichia coli O157:H7 EDL933
MKALSKLKAEEGIWMTDVPVPELGHNDLLIKIRKTAICGTDVHIYNWDEWSQKTIPVPMVVGHEYVGEVVGIGQEVKGFKIGDRVSGEGHITCGHCRNCRGGRTHLCRNTIGVGVNRPGCFAEYLVIPAFNAFKIPDNISDDLASIFDPFGNAVHTALSFDLVGEDVLVSGAGPIGIMAAAVAKHVGARNVVITDVNEYRLELARKMGITRAVNVAKENLNDVMAELGMTEGFDVGLEMSGAPPAFRTMLDTMNHGGRIAMLGIPPSDMSIDWTKVIFKGLFIKGIYGREMFETWYKMAALIQSGLDLSPIITHRFSIDDFQKGFDAMCSGQSGKVILSWD

SEQ ID NO: 67363 - protein, 133 aa, Bradyrhizobium japonicum USDA 110
MAAMKREALRVEPISSFLDRWKAPTSPVTRAGNMIFVAGLPPFDPDTGEIASAPIERQSEIIMEQMKLCLETAGASLDNVMKCNVYCTSTKHFAAFNAVYARYFPVDPPARIFVCTPEWFAPFDVEIDCIAMM

SEQ ID NO: 67364 - protein, 383 aa, Magnaporthe grisea 70-15
MLALRRVAAAAPVARQFSAAPRAAATFAFSRYYSSQGERVAKFTGKKDASGRYPVSLIEGDGIGPEISEAVKQIFEAAKAPVSWEPVDVTPILKDGRTAIPDAAIESIERNKVALKGPLATPIGKGHVSLNLTLRRTFNLFANLRPCRSVAGFKTPYDNVDTVLIRENTEGEYSGIEHVVVDGVVQSIKLITREASERVLRFAFQHAQEIGRKKVRVVHKATIMKMSDGLFLSVGQQVAKDFPGIEFDAELLDNTCLKMVTDPLPYNDKVLVMPNLYGDILSDMCAGLIGGLGLTPSGNIGDECSIFEAVHGSAPDIAGKGLANPTALLLSSMMMLRHMGLGEYADRIEKATFDTLAEGKALTGDLGGKAKTHEFAGAIISKL

SEQ ID NO: 67365 - protein, 112 aa, Pseudomonas putida KT2440
MSQELQIIDLVEGDGKAAVKGALITTQYTGWLADGSEFDSSWSRGKPFQCVIGTGRVIKGWDLGLMGMRVGGKRKLQVPAHLGYGERSVGAIPPNSDLTFEIELLEVLTRDD

SEQ ID NO: 67366 - protein, 113 aa, Zea mays
  misc_feature (46)..(46): Xaa can be any naturally occurring amino acid
  unsure (1)..(113): unsure at all Xaa locations
MSGRGKGGKGLGKGGAKRHHKVLRDNIQGITKPAIRRLAMTGGVKXISGLIYKETRGVLKIFLENDIRDTVTYTEHARRKTVTVMDVCYTLKRQGRTLYSFSGYAPFPYDALM

SEQ ID NO: 67367 - protein, 397 aa, Xanthobacter flavus
MIAFRTLDDAVDLADKRVLVRVDLNVPMESGRVTDATRLKAILPTIRDITGKGGKAVLLAHLGRPKGRDESQSLAPVAKALEGELGRKVAFASDCIGDEAKSAVSRLASGEVIVLENTRFHAGEEKNAPDFIEALASLGDIYVNDAFSTAHRAHASTEGLARKLPAYAGRSMESEIEALTKALEAPQRPVLAVVGGSKVSSKLELLGNLVKKVDILVIGGGMANTFLAALGKKVGKSLCEHDLANTARDILKKAEAAGCEIVLPVDAVVATEFKANAAHRVTSVDDVKDDEMMLDAGPETVGIVKQKLDGAKTVVWNGPFGAFEMTPFDAATVAVARYVGDLTHKGRLLSVAGGGDTVAALNHAGTAERFSYVSTAGGAFLEWLEGKALPGVEALRR

SEQ ID NO: 67368 - protein, 464 aa, Zea mays
  misc_feature (163)..(163): Xaa can be any naturally occurring amino acid
  unsure (1)..(464): unsure at all Xaa locations
MTPPASTSGKRAVAIDEPLLPESSAGGRHGGGASVSGAVFNVSTSIVGAGIMSIPAAMRVLGVVPAALLIAAVAALADVSVEFMLRYTGRGWGGGGKDEAATSYAGTMGDAFGRAGAALLNVFVALTTTGTLVVYLIIIGDVMSGSVGGGDEHAGVLQELFGXQWWTGREFVLLVTAVFVLLPLVLRRRVDSLRFTSAISILLAVVFMLISSGIALYALFKGTATMPRMFPDFSRLSSPFELFTAVPVIVVAFTFHFNVHPIRAELSKTSDMKVAVRVSLVLCAAIYAAVGFFGFLLFGDATMADVLANFDRSSGAGVPQALNDAARLSYALHLVLVFPLLLFSLRVNVDELLFPGRRPLAADTRRFVSLTAVLMAVLYVLAIAIPSIWTLFEYSGSTFAVTISLIFPGAIVLRDVHGIAKRKDKVLAATMIVLAVVTSSIAIASNIMSSISDEDRGGHVAGRR

SEQ ID NO: 67369 - protein, 492 aa, Mycobacterium bovis AF2122/97
MMSASWLRHRVSERGLIATAEQLWADSFRLALVAAHDDGDSLRVVYLFLAGYPDRRVELEYVVPADNPEIRSLAYLSFPAGRFEREMADLYGIRPVGHPKPRRLVRHAHWPDWHPMRTDAGPAPEFTDTGAFPFLAVEGPGVYEIPVGPVHAGLIEPGHFRFSVAGETIVRLKARLWFVHRGIEKLFHGRPATAAVDLAERISGDTSAAHALAHSLAIEDALGIELPHEIHRLRALIVELERLYNHAADLGALANDVGYSLANAHAQRIRENLLRRNAAVTGHRLLRGAIRAGGVALRALPDTDELAALAVDLAEVATLTLANSVVYDRFAGTAVLHPDDASALGCLGYVARASGLRSDARVEHPTIVLPITEIGAPDGDVLARYTVRRDEFAASAALAQHIVESHTGPIEYAATLHPVGAPSSGIGIVEGWRGTIVHRVEIDVDGRITRAKVVDPSWFNWPALPVAMADTIVPDFPLANKSFNQSYAGNDL

SEQ ID NO: 67370 - protein, 108 aa, Ashbya gossypii ATCC 10895
MSMSLMRPTTAPSEGEAPKKKFQIKKWIAVAFWSWDIAVENCAICRNHIMEPCIQCQPNAMTDTENECVAAWGTCNHAFHLHCINKWLLTRNACPLDNKTWQFAKYGK

SEQ ID NO: 67371 - protein, 494 aa, Bacillus clausii KSM-K16
METIGALAKKAMLQHADNVAVSDEDGTLTYGQLKKRACQLAHALLQSGLNKGDRVATLMSNRKEHIEIDAAIAFAGLVKVPVNYRLHPKEATYIIEHAGAGVVIGERQLLAGLSANVERIDVEEAYEPFLQMQSDDFPDVAVGEDDLFAIMYTSGTTGKPKGAMLTHRNMIAGALSLIQACEITYGDTIGHVAPLTHGTNFLAQTAWFYGLKQVVFKKFEPSGFIDELEKQQVTVMFMVPTLVNLMVHDPCFDPVKLRSLKSINMAGAPIAVPKLQKALTALGPKLAETYGLVEAPMAITIMPKQQLGARPSSCGATGPFAEVKIVAPDGEEAPVGDIGEVACRGSLVMKGYWQNETATAEAIKDGWFYTGDLGRLDDKGYLHLMDRAKDVIITGGLNVYPREVEEVLNQYPAVKETCVFGAPDEKWGERICAHVVLQAGAAPVTEAALIAHCTEHLARYKKPKVIEFVHELPKNSYGKIMRKTLRNQYKKAGV

SEQ ID NO: 67372 - protein, 509 aa, Zea mays
MIANGLRKSSAASSQVSKLVKYIASAGSLQGGHSLSEPSARHYSSEPSLQATEENGFKGHSMLAPFTAGWQSTDVHPLVIERSEGSYVYDSNGKKYIDALAGLWCTALGGNEPRLVKAATEQLNKLPFYHSFWNRTTKPSLDLANDILSMFTAREMGKVFFTNSGSEANDSQVKLVWYYNNALGRPDKKKFIARSKSYHGSTLIAASLSGLPALHQKFDLPAPFVLHTDCPHYWRFRLPDETEEEFSTRLANNLENLVLKEGPETIAAFIAEPVMGAGGVILPPKTYFEKIQAVLKKYDILLIADEVITAFGRLGTMFGCDMYNIKPDLVSIAKALSSAYMPIGAILVSPEITDVIYSQSNKLGSFAHGFTYSGHPVSCAVAVETLKIYKERNIVEHVNKIAPRFQERIKAFSGSPIVGEIRGLGLILGTEFVDNKSPNDPFPAEWGVGSIFGAECEKRGMLIRVAGDSIMLSPPLIMTPNEVEEIISKFGDALKATEERIGELKSRKN

SEQ ID NO: 67373 - protein, 332 aa, Acinetobacter sp. ADP1
MNSLNTNNEFSLQELQKESVMGVMGTETQREVRVIDLSDFEQRKYEIADQLWDAAVEIGFFQVSHHGIPQQDIEHAFGLAEQFFALPREVKAQYPLKRNSGWESKAQIRPSTKTPDQKESYQVTRPRMTGLWPTQQELPDFKEQVLNFESQCWSVGMKILSCFAYKMGFSEDFFTLAHDPSKETYQSTLRMLHYYAVDPAFKDELGLWRAGAHTDFDCLTLLFQQKGQGGLQVCPGKEMENRAWTSIEPREDVITCNIGDMLMRWSDDVLPSNFHRVKNPADHEYQGARYSLAFFCQANEDVLIQSPKGKYPDITAKDYLAQRVSANFSGKY

SEQ ID NO: 67374 - protein, 201 aa, Prochlorococcus marinus subsp. pastoris str. CCMP1986
MSSKLRVGVAGPVGSGKTALVETLCIALKKRYKIAVVTNDIYTKEDANFLIKKKILEEGRIVGVETGGCPHTAIREDCSLNKNAVMDLENKYDPLDFIFVESGGDNLAASFSPELVDLSIYVIDVSAGDKIPRKGGPGITRSDLLLINKIDLADMVGANLNIMQNDTNMMRDGKPWFFTNLSSGSGVDNVIKYLVAQIPNI

SEQ ID NO: 67375 - protein, 892 aa, Oryza sativa (indica cultivar-group)
MVSSRFVAVFLLVALAPAARGQGGGGGNSSAPAASPPGPFVPRDNILLDCGATGQANDTDGRLWTGDTGSKYLPANLAAAAATAQDPSVPQVPYLTARFSAAPFTYSFPVGAGRKFLRLHFYPANYSNRNAADALFSVSIPDPNITLLSNFSAYQTALALNFDYLVREFSVNVTASTLDLTFTPEKGHPNAFAFVNGIEVVSSPDLFGSSNPMEVTGDGSGTPFPIDAGTAMQTMYRLNVGGNAISPSKDTGGYRSWEDDTPYIPFASFGVSYANDTNVPINYPDSIPQYVAPADVYSTARSMGPDNNVNLQYNLTWAMQVDAGYQYLVRLHFCEIQSGISKINQRTFDIYINNQTAFSGADVIAWSTGLGIPVYKDFVVFPMGSGPMDLWVDLHPNVKNKPQYYNAILNGMEVFKLQLTNGSLAGLNPVPSIVPTASGGNSGKKSSVGPIIGGVIGGLVVLALGCCCFFVICKRRQRAGKDSGMSDGHSGWLPLSLYGNSHTSSSAKSHTTGSHASSLPSNLCRHFSFVEIKAATNNFDESLLLGVGGFGKVYRGEIDGGATKVAIKRGNPLSEQGVHEFQTEIEMLSKLRHRHLVSLIGYCEEKNEMILVYDYMAHGTLREHLYKTQNAPLSWRQRLDICIGAARGLHYLHTGAKHTIIHRDVKTTNILLDEKWVAKVSDFGLSKTGPTMDHTHVSTVVKGSFGYLDPEYFRRQQLTDKSDVYSFGVVLFEVLCARPALNPTLAKEEVSLAEWALHCQKKGILDQIVDPHLKGKIAPQCFKKFAETAEKCVSDEGIDRPSMGDVLWNLEFALQMQESAEDSGSIGCGMSDEGTPLVMPGKKDPNDPSIESSTTTTTTTSISMGEQSVASIDSDGLTPSAVFSQIMNPKGR

SEQ ID NO: 67376 - protein, 141 aa, Ralstonia solanacearum GMI1000
MAIERTLSIIKPDAVAKNVIGQIYARFEGAGLKVVAAKMIHLSRAEAEQFYAVHKERPFFKDLVDFMISGPVMVQALEGESAIVKNRDLMGATDPKKAEKGTIRADFADSIDANAVHGSDAAETAAVEVAFFFPGLNIYSR

SEQ ID NO: 67377 - protein, 347 aa, Prochlorococcus marinus str. MIT 9303
MAVVCRRITASSRTYSLSALTRCLQEEAAAIAVAAERLSSSQVEKALVLLERCGDQRAKLVITGVGKSGIVARKIAATFSSIGLMALYLNPLDAMHGDLGVVAQEDVCLLLSNSGETAELLEVLPHLKRRGTARIALVGKPDSSLARGSDVVLEASVDREVCPLNLAPTASTAVAMAIGDALAAIWMERRNISPADFAFNHPAGSLGKQLTLTASDLMVPVAKVQPLQPNTSLQDVICKLTQDGIGSGWVEDPSTAGLLLGLITDGDLRRALRDHSAENWASLSAADLMTADPITVDADLLAVEAIKQMECNRRKPISVLPVVGPDSSGNLLLGLLRLHDLIQAGLT

SEQ ID NO: 67378 - protein, 520 aa, Mycoplasma hyopneumoniae 232
MLQERSKMTKKCYITTPIYYASGRLHIGHLYTTVLAWVIRNFKKMSGFEARLFTGSDEHGQKISQLAAKANLEPQEFVDKNVENFKFLWEKFEIDYDYFQRTTNLNHKNFIKKIFLKMYEDNHIFNGEYQGLYSISDEEFLSQSQAVYQNRNYFHPVSGAKMELISEKSYFFPIKKFQKWLEDFLLENPKFIFDSKIANELRQNFLQKGLEDLSVTRKNLKWGIFLDQKFENQTIYVWLDALFSYLSVFKDQIDLENPKKSNFWTDSAQIIQVVGKEIARFHCIYWPIFLKSLNFRLPSIILTHGWLITPEGKMSKSKGNVINPLDLLKKFDPEIIKFYFVSQINTKNDSVFDENLLENFYNSFFVNTFGNLISRTIALIVKKFDQPLLFEIADLDWTDISFYEKILLSLDEFCDNFDQLEIEKAFKTVIELTKNLNGFFDIKQLWNQKNLKKLAQGLILVLNGIYAITVFLSIAMPKKTNEILEFLGINEKNFLLITKLDKFDKINFKKLEKPFFPRKN

SEQ ID NO: 67379 - protein, 520 aa, Aspergillus nidulans FGSC A4
MAKVDQKVVLIVIDGWGVAGPNSPKEGDAIAAAETPFMSGFAEENSKTAQGYTELDASSLAVGLPEGLMGNSEVGHLNIGAGRVVWQDSVRIDQTLKKGELNKVENIAASFKRAKDGNGRLHLLGLVSDGGVHSNITHLIGLLKVAKEMEIPQVFIHFFGDGRDTDPKSAAKYMQQLLDATKEIGVGEIATVVGRYYAMDRDKRWDRVEIAIKGILSGEGEESSDPVKAIEKRYTEDETDEFLKPIIFGGKDRRVQDDDTLFFFNYRSDRVREITQLLGDYDRSPKPDLPYPKNIHITTMTQYKTDYTFPVAFPPQHMGNVLAEWLGKKDVQQCHVAETEKYAHVTFFFNGGIEKQFPGEVRDMIPSPKVATYDLEPEMSAEGVGKKVEERIAEGKFEFVMNNFAPPDMVGHTGVYEAAIKGVAATDKAIGIIYEACKKHGYTLFITADHGNAEEMLNEKGTPKTSHTTNRVPFIMANAPEGWSLRKQPGVLGDVAPTVLAAMGIEQPKEMSGESLLVKA

SEQ ID NO: 67380 - protein, 53 aa, Arabidopsis thaliana
QHSKVSPTKLSSATMVSSPAQATRVAPFMRLKSAAAFRATRKANNDIASSTIN

SEQ ID NO: 67381 - protein, 322 aa, Oceanobacter sp. RED65
MSFNYIESIQRTIADERDAVDQLLKNLNHEALNTACDLLLNCQGRIVVTGMGKSGHIGNKIAATLASTGSPAFFVHPGEAAHGDMGMITEQDVVIALSNSGESSEVTTLIPLLKRLNVPLISMTGNDTSTLATGADSHINVGVEKEACPLDLAPTSSTTVALVMGDALAIALLEARGFTAEQFAFSHPGGSLGRKLLLKVKTIMHCGSQIPQVKPDTLVKDALIEMTQKGLGMTTVIDEHGQLSGIFTDGDLRRTLDKDIDFHTTPVQAVMTTGVTTIDPERLAAEALQVMEEKKINALVATENGKVAGVINMHDLLRAGVI

SEQ ID NO: 67382 - protein, 368 aa, Rhizobium leguminosarum bv. viciae 3841
MKIHAAVARAPHTPFSLERLDLEEPREGEILVRVVATGVCHTDIVMRDQHLPVPQPVVLGHEGAGIVERVGPGVAKVKPGDHVVMTFNSCGHCPSCNDHQETYCHEFFPRNFFGARADGSSGLSCEGVRVHGNIFGQSSFASHALCHERNIVKVPEDADLALLGPLACGIQTGAGAVMNALKVEPGKVLAVFGMGSVGLAAVMAARIVGASRIIAVDVNETRLALAAELGATDIVNGKASDAVAAIMALTGAGVDYSIDASGVPAVIDQCVRVLAPRGTCGIVGASPHGATLTLDLTHILSGGRRVRGIVEGDSNPDVLIPLLIDLHRQGRFPFDRLITFYDFADINQAVEDSEKGIVLKPVVRQPAV

SEQ ID NO: 67383 - protein, 538 aa, Phanerochaete chrysosporium
MLVSVDALALRTLVYELTYLLYPAVPTAAALILLQRFGNVWLPTWTIVLLSLCNVPVAHRILVWLKDGRRWPGSIDLLRQLTQTFETGFLSEMLWGYMHVLGQTFEVYILWDSNYVTSDANVIKTILATDFDNFVKGEKLDVCVRPVLGTGVFNSDGEMWKFHRSMTRPFFTRERISHFDLFDRHADATMAKMKARLAEGFAVDFQDLISRFTLDSATEFLFGQCTTGASRTEDFARAFAEAQDAVSFRLRMGWLWPDAVARADKIKRENGGRVPEVKGEIEEDETLLDHLVNVVQTKILHDEVLNIMIAGRDTTGGTLTSAVYFLSQYPEVLRRLREEILEKVGPTRRPTYDDIREMKYLRAFINETLRLYPAVPWNVRYPVKDTTIPGPHPDKPYFIPANTPVSYSVHCMHRRTDYWGPDAEAFDPDRFLDARVQRYLTPNPFIFLPFNAGPRICLGQQFAYNEMSFFVIRLLQHFDEVQLCEDALAPDCRVPDAWRGAPGRKGVERFWPKAHLTLYAKGGLWVKMREASTSEAVV

SEQ ID NO: 67384 - protein, 351 aa, Synechococcus elongatus PCC 6301
MTDATPLLGRSLPELQDWVVAQGQPSYRAKQLYQWLYERSIHNLAEISVFPKAWRQSLQAVPVGRSQIVDRSVSPSGSIKYLLRLHDGEIIEAVGIPSGDRLTVCVSSQLGCAMACDFCATGKGGFRRHLAPHEIIDQVLTVQEDWQQRVSNIVFMGMGEPLLNLDAVLAAIRCLNQDIGIGQRGITVSTVGIPGHIRRLAETKRVGDRPLQFTLAVSLHAPNQAIRDRLIPSSRHYPITDLLQECRDYVQITGRRVTFEYILLAGLNDQPEQAEQLAQLLRGFQSHVNLIPCNPIDEVEYQRPSKARVDAFADALRQQRVAVTVRWSKGLGADAACGQLRANRSTATLPA

SEQ ID NO: 67385 - protein, 557 aa, Emericella nidulans
MSVQTVSIQPFGDQKPGTSGLRKKVKIFQQENYTESFLTSIFLSIPEGAQDAFLVIGGDGRYYNSDVIQKIAKIGAAYGVKKLIVGQNGILSTPAASNLIRKRKATGGILLTASHNPGGPDNDFGIKYNLTNGAPAPEQVTNKIYEVSKSLTSYKYIDLPEVDTTTVGTRSYGPLEVEVVHSTEDYVSMMKEIFDFDLIRSFLKKHPDFKVLFDGMHGVTGPYGIDIFVNELGLPSSSTMNCIPKPDFGGGHPDPNLVYAHELVEAVDKNGIHFGAASDGDGDRNMIYGANTFVSPGDSLAIIAHHAKLIPWFQKHGVDGLARSMPTSGAVDRVAKAQGLQSYEVPTGWKFFCNLFDNKKMSICGEESFGTGSNHIREKDGVWAIVAWLNVIAGVAEQKPNETPSIASIQAEFWETYGRTFFTRYDYENVDSDGANKLIAALSEKAESTTRAHLLAAPSLGRKVVDSGNFAYTDLDGSVTKNQGLYVKFDDGSRLVVRLSGTGSSGATIRLYVEKYEGDKSKYQMATQDYLKDNVGLALELLKFKEFVGREEPDVKT

SEQ ID NO: 67386 - protein, 279 aa, Campylobacter jejuni RM1221
MQNILSSFTQEKNVCVFTNTLKISIEELEKEFLKQKLKFKKINAYCYLFDAKDKAILSSMKVFNEAHFYIQNYSSYLCALNLEVKAGQRVLDMCAAPGGKSINLANFMQNTGYLACNEMSRDRFFILQKNLKNYGVNAKVFMKDGKNIGNLCPLKFDKILLDAPCSTFAKIGFDLEKSYKEIKNIAKTQKKLLHSALKALKIGGELVYSTCTFTKEENEEVIENALKSEFKLELLDIDLENVEAKAGQSEEFAEISKCRRILPSLDYDGFFIAKLRKLC

SEQ ID NO: 67387 - protein, 302 aa, Paracoccidioides brasiliensis
MTSERESKTFLARLCEQAERYDEMVTYMKEVANLGGELTVDERNLLSVAYKNVVGTRRASWRIISSIEQKEDSKGSEKHVAIISEYRQKIETELERVCQDVLDVLDQSLIPKAESGESKVFYHKMKGDYHRYLAEFASGNKRKVAATAAHEAYKNATDVAQTELTPTHPIRLGLALNFSVFYYEILNSPDRACHLAKQAFDDAIAELDSLSEESYRDSTLIMQLLRDNLTLWTSSDGAEPEPVAAGDGKDDKTAEGEEGPATATTTDAPAPEEVAAPAAADEEPKKEGTNGVLKYGFKKNLF

SEQ ID NO: 67388 - protein, 403 aa, Acinetobacter sp. ADP1
MERIVVVGAGQAAGWAVSTLRQEGFQGEIHVVSNEHQIFYERPPLSKQVLSKEASYDSLNLFSPEQIDAFSVQWHKPDLATQIDRDHKQVILESGKILPYDKLLIATGSRARVPVNTWKDISNVVTLRDVQDCERLANLLETAKSIAIIGGGWIGLEIAATARKQGKQVHVFEYAERLCGRSVSPEVSEFLKEIHEQQGTKIHLNSKNLHLIESSDQTVQVLNHPETAQTFDCVVVGAGAEIAKELGVSAGLAVKDGIVVNCYGQTSDVDIYAAGDVAIHPVLGYCIQSWANAQNQAIAAAKSMLGVATEYSDIPWLWSDQYQFNIQILGTYQAQSNPKLIIRQSSPAQLSYLYLDEHNRLMNLIAVNDAKLVKLAKRWIQNSTVLDPKLLADPEFNVMKLKP

SEQ ID NO: 67389 - protein, 793 aa, Kluyveromyces lactis NRRL Y-1140
MSVIYRGTHSEESDGRASDSSSLSQIQLQITVKNENTISLEKDIKEEELVNESEFHDSESIDEDDGLVWKGDPTYLPNSPYPDVRFAVSIEDDPTIRLNHWRTWFLTTIFVVVFAGVNQFFSLRYPSLSIDFIVAQVICYPIGKVLAKLPDWKCRRVPFFDLNPGPFTKKEHAVVTIAVALTSSTAYAMYILNAQGSFYNMKLNVGYQFLLVWTSQMIGYGAAGLTRRWVVNPASAIWPQTLISVSLFDSLHSRKIERAVVNGWSMPRYKFFVIVFIASFVWYWVPGFLFTGLSYFNVILWGPKTRDNFVANTIFGVESGLGAFPISFDYTQISQAMSGSVFATPFYVSANTYASVLLFFVIILPCLYFSNTWYAKYMPVISGSTYDNTQSKYNVTKILNEDYSINLEKYKNYSPIFVPFSYLLSYALNFAAVIAVFVHCILYHGKDILAKLKDRRNGGTDIHARIYSKNYADCPDWWYLVLQVVMIGLGFVTVCAFDSKFPAWAFVIAILISLVNFIPQGILEAMTNQHVGLNIITELICGYMLPLRPMANLLFKLYGFIVMRQGLNLSRDLKLAMYMKVPPRLIFFIQIYATILSGMVNVGVQEWMTHNIEGICSTDQSNGFTCANGRTVFNASIIWSLPKYLFSPGRIYNPLMWFFLIGLVVPLIVYAIQRKFPKIQFAKYIHTPVFFTGPGNIPPSTPYNYSLFFSASFCLHIIRKRWGPWFKKYNYVMGAAVESGVAIAVVIIFLCVQFPGAELNWWGNNVWKNTYDHNYKKFYTLEEGQTFGHTKWW

SEQ ID NO: 67390 - protein, 551 aa, Gibberella zeae PH-1
MSAEAPAQDAPQQESRARKDSFSGKSQTSETSQTAAEFIRSQEALEADAREALPYSIDTCTKILGPLRQAVFACLTCNPPPAKEGDDWTPAGVCYACSIQCHGEHNLVEIFQKRNFTCDCGTKRIPSTSPCTLRLNEATNTRGGVHSEEPDVNNKYNHNFCNRFCGCHCDYDPFQQKGTMFQCLGLGTVETGGCGEDWYHPGCLVGMGPNWFEKMEKPKKTAPENNEEGKLTTIAEGNEEKQDPAQTAGQDKEKAAENAVEADEDEDEDVPMPPGFPEEDAFEAFLCYKCVEAHPWIKRYAGTSGFLPAVFLNQPDSEPKKEPESAKEESVHTTETAVAAEGGQDSRKRKADDDVEEPTDIKRIKSESQSGDEKPAEETTPTDKLPCKLKNLPPAPQGQFSLFLKEDFREAFCRCSSCYPHLNPHPQLLEEEEVYEPPLSDGGSQVDGDGGGSHGSGSLLERGESALRNVDRVRAIEGVMAYNHLKEQLKPFFQQFAESGQAIGAEDIKAYFAKLRGDEKGIEEAAAGAKDGEGSGSGSGDGDNRKEQSGF

SEQ ID NO: 67391 - protein, 794 aa, Kluyveromyces lactis NRRL Y-1140
MNHIKSVLSADAPVTEKVLLDVGQERSFINSSDDNLNLEDKKRGLEVNVFAARSDYLLGSQLSHEVIEDEYAGIVVEDDSAYPEVRAAVPSSDDPTLPQNTVRMWVIGMLMATVGSGLNLLFSLHSPSIVLSAFVTSILAWPIGKAWDKVMPDVKLFGRFGGPSLNPSPFNLKEHCLIQIMANVSFGGGEAYATDIFLAMNNYFEADFGWGFDIVTILATQCIGFALAGLVKDILITPASMIWPSNLVTCTFLTNLHINENHMANGWKISRLKFFFMVFIIGFVYYWFPGFIFQALSYFAWVTWIRPDNVIINQIFGASTGLGIIPLTFDWNQIAGYVGSPLVPPVSTIFSILLSMIMIFWVTVPAIHYSNVWFGKYLPISDSGSYDRFQQSYNVSKIVTPNLSFDIDAYKSYSPLYLPATFVISYGMSFASNTATLVHAGLFHGKEITGAFRNVKKEQEDIHNRLMKNYRDVPHWWYGIVFLVFFGLAIAGIRAWNTEMPVWALIFALVIAGVFLVPIGIICAVTSISVGLNVLTEFIIGYILPGKPIAMMFFKTFGYITNHQAVTYAQDMKLGHYMKIAPRLMFSAQFIATVWSSVVQVCVLKWAQGNITDVCDAHQKSHFTCPNARVFFNAAIIWGVIGPQRMFSSGQLYSKVLWFFLIGASLPLINWLVLKKWPKSPIKYLNWPVFFSGTGLIPPATPYNYGSYCMVGITFGYFIKRKWFHWWTKYNYSLSAALDISLAWSSLMIFFCLTLTNTNAPNWWGNTVIDTIDYEGTAIQSILNDGESFGLTKW

SEQ ID NO: 67392 - protein, 270 aa, Gibberella zeae PH-1
MAERNLSQIISQLKHSPSMSYTDANALLSKAKLALLKLNALTPSPSTPTQLLPLARETYEQGALFAIRARNPEAFTRYVQQLQPFYELPASVLPPNLLERNKVTGLSLLLLLTQGRYAEFHTELESLENREGGGGDVESDRYLGYPIRLERWLMEGSYDRVWKAMKSSEVPCDEYSVFSEILKNQIRSEIASSSERAYPSLPISSTKSLLFLDSEGDVISFAHHRGWIVRDGHIYFPDAAEGENGDQNKEMSQMVIENALGYARELETIV

SEQ ID NO: 67393 - protein, 303 aa, Triticum aestivum
MAHVLAAAEPLTLLKRPPPQNDGFGDDNGSTEEKAPKARRRESDPAAALAAARHGFGEHGGVNMSKLVVDNTFTPVVVSPARLGADIVVHSVSKFISGGADIIAGAICGPASLVNSMMDLQDGALMLLGPTMNAKVASELAARLPHLPLRMQEHSRRAAEFAARMRRQGLRVTYPGLPDHPHHARLRAMGNPGYGAGGMLCLDMGTEERANRLMYHLQNTTQFGFMAVSLGFYDTLMSCSGNSTSSEMDPEDRARAGISPGLIRMSVGYNGTLEQRWAQFERALALMQQQDTPAAAAKYGKPV

SEQ ID NO: 67394 - protein, 137 aa, Arabidopsis thaliana
  misc_feature (53)..(53): Xaa can be any naturally occurring amino acid
  unsure (1)..(137): unsure at all Xaa locations
ARNPGGAHRGPNRAKEEGNHQEVVWVSFMLSSAVGVTSPVKATMVVQLTGWKXSVEFPATRRTNRAIISIEGNGGGVSCLKGWPPIGKKKLGTLFNLPDLRDVKLVKEVDYLFRTRGIPGVEFKLKHGFGYRGHGTT

SEQ ID NO: 67395 - protein, 491 aa, Ralstonia eutropha JMP134
MSLTLANAALLRSQNFINQQWRDAGLGRRLAVANPATGEVFAHVPDSDDDDAGRAADAAAEAFPAWSARPARERAQLIKRWHALILANQEDLARIISTEQGKPLKEARGEVLYGASYVEWFAEEATRICGDIVAEAVPGRKLLVLKEPVGVVAAITPWNFPLAMIARKIAPALAAGCTVVAKPAEDTPLTALALVWLAEQAGLPAGVLNIVTASRESTPNVVDAWLADSRVRKITFTGSTPVGKHLARESAGTLKKLSLELGGNAPFIVFEDADLDAAVDGLMASKFRNGGQTCVCPNRVYVHESVHDDFVERLARRVGALHVAPATDENAQIGPMINARAVDKIARHVEDAVAKGARVVTGGRRVRTADGPHYYAPTVLIDATPAMELACEETFGPVAPVFRFRDESEVIRDANDTPFGLAAYFYSNDVRRIWRVAQALETGMVGINEGAIAAEAAPFGGVKESGYGREGSRHGLDDYMHTKYLCQGQLG

SEQ ID NO: 67396 - protein, 191 aa, Erwinia carotovora subsp. atroseptica SCRI1043
MSKKVAVLLAPGFEEAEAIMVIDVLHRMKIEVTMLSCHDRLELHSYHNIRMFADALLERNQDTLFDAVVIPGGPQGTVNLAANPMVVEFIRRHDDAGKLICPLCSAAARVLGGNKLLKGRRYVCSGDLWQDVTDGVYVNEKVVEDGNLISGKGLGVSFDFAFTIATRLTGDKEDANFQVEHIDYDYWRVPA

SEQ ID NO: 67397 - protein, 326 aa, Oryza sativa (japonica cultivar-group)
MAHFQGQQHGHPAARVDEYGNPVAAGHGITGTQEAGAGGYGAAGNVAQPQHAFGGATDAGGYGRQAGYGATGTGTHDAAGYGGSGQPAYGATGTGVHDAGGLMPGHTAGHGTTGTGVHHGAGAGLPAGQTAGYGTTGVTGAQHGAGGLGTGHTAGYGTTGAHHGAGGLGTRHMAGHGATTTPDTMAYGTTGTGAPHGATAGTGAYPHAGGQFQPAREEHKTGGILRRSGSSSSSSSSEDDGMGGRRKKGIKEKIKEKLPGGNKGGQQQPTATAATGGYGAGTGHTAAAGTTTDAGGTAYTPTTQPTHEKKGMMEKIKEKLPGGGHH

SEQ ID NO: 67398 - protein, 168 aa, Glycine max
ITQRKEEMSEAAATTTSSSMMRNYPLISAIVAFAIAQFIKFFTAWFKEKRWDPKQLVGSGGMPSSHSATVTALAAAIGFHEGFGGPLFATALVLACIVMYDATGVRLQAGRQAELLNQIVYELPAEHPLAESRPLRELLGHTPPQVVAGGILGLITAGIGYLITMASS

SEQ ID NO: 67399 - protein, 379 aa, Aubrieta deltoidea
MSTTGQIIRCKAAVAWEAGKPLVMEEVEVAPPQKHEVRIKILFTSLCHTDVYFWEAKGQTPLFPRIFGHEAGGIVESIGEGVTDLAPGDHVLPIFTGECGDCRHCHSEESNMCDLLRINTERGGMIHDGESRFSIDGKPIYHFVGTSTFSEYTVVHSGQVAKINPEAPLDKVCIVSCGLSTGLGATLNVAKPKKGQSVAIFGLGAVGLAAAEGARIAGAGRIIGVDLNPKRFEEAKKFGVTEFVNPKDHEKPVQQVIAEMTDGGVDRSVECTGSVQAMIQAFECVHDGWGVAVLVGVPSKDDAFKSHPMNFLNERTLKGTFFGNYKPKTDIPGVVEKYMNKELDIEKFITHTVPFSEINKAFDYMLKGEGIRCIITMGA

SEQ ID NO: 67400 - protein, 246 aa, Ralstonia solanacearum GMI1000
MPTAVSDAAAPAQARAWIEAAERVMVLTGAGVSAESGVPTFRDALTGLWARFNPEDLATEAAYREHPRMVWDWYQERRARVSQVQPNPAHLAIAALATRKTVALVTQNVDGLHQRAGSVGVIELHGNLFANKWLDGCGKCDVATAEPGRPPRCAACGAMLRPGVVWFGERLPVVANYRAEEAANTCDVCLVVGTSGMVYPAAGLPGLAKDHGARVIVVNPEPSVLDETADLVIHQPAGVCLPAMLA

SEQ ID NO: 67401 - protein, 379 aa, Arabis alpina
MITTGQIIRCKAAVAWEAGKPLVMEEVEVAPPQKHEVRIKILFTSLCHTDVYFWEAKGQTPLFPRIFGHEAGGIVESVGEGMTDLAPGDHVLPIFTGECGDCRHCHSEESNMCDLLRINTERGGMIHDGESRFSIDGKPIYHFVGTSTFSEYTVVHSGQVAKINPEAPLDKVCIVSCGLSTGLGATLNVAKPKKGQSVAIFGLGAVGLAAAEGARMAGAGRIIGVDLNPKRFEEAKKFGVTEFVNPKDHDKPVQQVIAEMTDGGVDRSVECTGSVQAMIQAFECVHDGWGVAVLVGVPSKDDAFKTHPMNLLNERTLKGTFFGNYKPKTDIPGVVEQYMNKELEVEKFITHTVPFSEINKAFDYMLKGEGIRCIITMGA

SEQ ID NO: 67402 - protein, 379 aa, Arabis alpina
MITTGQIIRCKAAVAWEAGKPLVMEEVEVAPPQKHEVRIKILFTSLCHTDVYFWEAKGQTPLFPRIFGHEAGGIVESVGEGMTDLAPGDHVLPIFTGECGDCRHCHSEESNMCDLLRINTERGGMIHDGESRFSIDGKPIYHFVGTSTFSEYTVVHSGQVAKINPEAPLDKVCIVSCGLSTGLGATLNVAKPKKGQSVAIFGLGAVGLAAAEGARMAGAGRIIGVDLNRKRFEEAKKFGVTEFVNPKDHDKPVQQVIAEMTDGGVDRSVECTGSVQAMIQAFECVHDGWGVAVLVGVPSKDDAFKTHPMNLLNERTLKGTFFGNYKPKTDIPGVVEQYMNKELEVEKFITHTVPFSEINKAFDYMLKGEGIRCIIAMGA

SEQ ID NO: 67403 - protein, 379 aa, Arabis alpina
MITTGQIIRCKAAVAWEAGKPLVMEEVEVAPPQKHEVRIKILFTSLCHTDVYFWEAKGQTPLFPRIFGHEAGGIVESVGEGMTDLAPGDHVLPIFTGECGDCRYCHSEESNMCDLLRINTDRGGMIHDGESRFSIDGKPIYHFVGTFTFSEYTVVHSGQVAKINPEAPLDKVCIVSCGLSTGLGATLNVAKPKKGQSVAIFGLGAVGLAAAEGARMAGAGRIIGVDLNRKRFEEAKKFGVTEFVNPKDHDKPVQQVIAEMTDGGVDRSVECTGSVQAMIQAFECVHDGWGVAVLVGVPSKDDAFKTHPMNLLNERTLKGTFFGNYKPKTDIPGVVEQYMNKELEVEKFITHTVPFSEINKAFDYMLKGEGIRCIITMGA

SEQ ID NO: 67404 - protein, 379 aa, Arabis alpina
MITTGQIIRCKAAVAWEAGKPLVMEEVEVAPPQKHEVRIKILFTSLCHTDVYFWEAKGQTPLFPRIFGHEAGGIVESIGEGVTDLAPGDHVLPIFTGECGDCRYCHSEESNMCDLLRINTDRGGMIHDGESRFSIDGKPIYHFLGTSTFSEYTVVHSGQVAKINPEAPLDKVCIVSCGVSTGLGATLNVAKPKKGQSVAIFGLGAVGLAAAEGARMAGAGRIIGVDLNPKRFEEAKKFGVTEFVNPKDHDKPVQQVIAEMTDGGVDRSVECTGSVQAMIQAFECVHDGWGVAVLVGVPSKDDAFKTHPMNLLNERTLKGTFFGNYKPKTDIPGVVEQYMNKELEVEKFITHTVPFSEINKAFDYMLKGEGIRCIITMGA

SEQ ID NO: 67405 - protein, 287 aa, Arabidopsis thaliana
MSQFASGSTEVPAFSSQLSEEGSDLEGSEDEVKPKQSISRKKWTAKEDIVLVSAWLNTSKDPVIGNDQQGQSFWKRIAAYVAASPSLDGLPKREHAKCKHRWGKVNKSVTKFVGCYKTTTTHKTSGQSEDDVMKLAYEIYFNDTKKNFTLDHAWRELRYDQKWCEATSRKGDKNAKRKKCGDGNASSQPIHVEDDSVMSRPPGVKAAKAKARKSATIKEGKKPATVKDDSGQSVEHFQNLWELKEKDWDRKEKQSKHQQLERLLSKTEPLSDIDLFLKNKLITDLWS

SEQ ID NO: 67406 - protein, 379 aa, Cardamine amara
MITTGQIIRCKAAVSWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRKNTDRVGMIHDGVSRFSINGKPIHHFLGTSTFSEYTMVHSGQVAKINPEAPLDKVCIVSCGLSTGLGATLNVAKPKKGQSVAVFGLGAVGLAACEGARMSGASRIIGVDLNPKRFEEAKKFGVTEFVNPREHDKPVQQVIAEMTNGGVDRSVECTGSVQAMIQAFECVHDGWGVAVLVGVPSKDDAFKTHPMNFLNERTLKGTFFGNYKPKTDIPGVVEMYMNKELEIEKFITHTVPFSEINKAFDYMLKGESIRCIITMGA

SEQ ID NO: 67407 - protein, 379 aa, Arabis blepharophylla
MITTGQIIRCKAAVAWEAGKPLVMEEVEVAPPQKHEVRIKILFTSLCHTDVYFWEAKGQTPLFPRIFGHEAGGIVESVGEGVTDLAPGDHVLPIFTGECGDCPHCHSEESNMCDLLRINTERGGMIHDGESRFSIDGKPIYHFVGTSTFSEYTVIHSGQVAKINPDAPLDKVCIVSCGLSTGLGATLNVAKPKKGQSVAIFGLGAVGLAAAEGARIAGASRIIGVDLNSKRFDEAKKFGVTEFVNPKDHDKPVQQVIAEMTDGGVDRSVECTGSVQAMIQAFECVHDGWGVAVLVGVPSKDDAFKTHPMNFLNERTLKGTFFGNYKPKTDIPGVVEQYMNKELEIEKFITHTVPFSEINKAFDYMLKGEGNRCIIRMGA

SEQ ID NO: 67408 - protein, 379 aa, Arabis blepharophylla
MSTTGQIIRCKAAVAWEAGKPLVMEEVEVAPPQKHEVRIKILFTSLCHTDVYFWEAKGQTPLFPRIFGHEAGGIVESVGEGVTDLAPGDHVLPIFTGECGDCPHCHSVESNMCDLLRINTERGGMIHDGESRFSIDGKPIYHFVGTSTFSEYTVIHSGQVAKINPDAPLDKVCIVSCGLSTGLGATLNVAKPKKGQSVAIFGLGAVGLAAAEGARIAGASRIIGVDLSSKRFDEAKKFGVTEFVNPKDHDKPVQEVIAEMTDGGVDRSVECTGSVQAMIQAFECVHDGWGVAVLVGVPSKDDAFKTHPMNFLNERTLKGTFFGNYKPKTDIPGVVEMYMNKELEIEKFITHTVPFSEINKAFDYMLKGEGIRCIITMGA

SEQ ID NO: 67409 - protein, 253 aa, Synechococcus elongatus PCC 6301
MSFSDHFSAVAASYAKARPRYPQRWFRYLARIVPDRQRVWDCATGNGQAAIALAEYFSEVIGSDASAAQVRQARSHPRVQYLVFPAEATPLAPASLDLITVAQAAHWFDLPQFYIEAQRLLRPGGVIALWGYGLGSLNPAIDHVFNHFYRDWLDPYWPPERQWVEQAYEGLSFPFEPLPTPTFSMQCDWTLFDLLAYLRTWSGVQQFQRQRGFDPVWAIAPELQRVWGDPQRYRRITWPLFAKVGRWQPDRVR

SEQ ID NO: 67410 - protein, 107 aa, Triticum aestivum
MAKLMCLCFIILTIAVAVSADECEGDRQAMIKECAKYQKWPANPKLDPSDACCAVWQKANIPCLCAGVTKEKEKIWCMEKVAYVANFCKKPFPHGYKCGSYTFPPLA

SEQ ID NO: 67411 - protein, 307 aa, Triticum aestivum
MATLRPLTVEDVLRVNGSRRFAAALAAASPFDSLADALLAARRIWLNEVDVTGWLEAFAAHPPIGTTSSSVSKWSKEEQSAALSTATDSTAQELSEWNAKYREKFGFVFMICASGRTAPEVLAELKRRYANRPIVELEAAAEEELKITELRLAKLFSAETAAPPTSGENHISQPDKAAGSSNRTRPPITTHVLDTALGSPAAGIEVHLEMWKDASSPPSFDNKEFKGWTTLGTSITNNDGRSGQLMDIVDNVAPGFYRISFNTSKYAPSGFFPYVSIIFEIKRSQTTEHFHVPLLHSPFSFTTYRGS

SEQ ID NO: 67412 - protein, 827 aa, Gibberella zeae PH-1
MASSPMPSSPPEFNITHGVEDDDDIEEEVMIQDDIDDIDEMAEDEVDLFREGYENDYRDLEDDHYGGEGIDDEQYEDMRIDQRQQVDKVLNRRDRAIQERRGMPQVWGALDEDGDDIDLSAQPRRRRHNYDENPDDIMDTDIMSEELSLEALGDVKASSLTEWVSLPSVQRTIRREFKAFLTSYTDTSGSSVYGSRIRTLGEVNAETLEVSYEHLSESKAILAYFLANAPAEMLKLFDEVAMDVVLLHYPDYERIHSEIHVRIFDLPVHYTLRQLRQSHLNCLVRVSGVVTRRSGVFPQLKYVKFDCTKCGVTLGPFQQESNVEVKITYCQSCQSRGPFTLNSEKTVYRNYQKLSLQESPGTVPAGRLPRSREVILLWDLIDKAKPGEEIEVTGIYRNNYDAQLNNRNGFPVFATILEANNVVKSHDQLAGFRMTEEDEQNIRKLSRDPNIVDKIINSIAPSIYGHTDIKTAVALSLFGGVAKVTKGAHHLRGDINVLLLGDPGTAKSQVLKYAEKTAHRAVFATGQGASAVGLTASVRRDPLTSEWTLEGGALVLADRGTCLIDEFDKMNDQDRTSIHEAMEQQTISISKAGIVTTLQARCGVIAAANPIGGRYNSTAPFSSNVELTEPILSRFDILCVVRDTVEPEEDERLARFIVGSHSRSHPLSQAEQGSMEVEHDTQAETQGSTRKPEGEIPQELLRKYILYAREHCSPKLYHIDEDKIARLFADMRRESIATGAIPITVRHLEAIIRISEAFCRMRLSEYCAAQDIDRAIAVTVDSFVGSQKISCKKALARAFAKYTLARPGGQKKTGANSQGRRQTAAAS

SEQ ID NO: 67413 - protein, 394 aa, Synechococcus elongatus PCC 6301
MALLETRTEPMVLNMGPHHPSMHGVLRLIVTLDGENVIDCEPVIGYLHRGMEKIAENRSNVMFVPYVSRWDYAAGMFNEAITVNAPEKLANIPVPKRASYIRVIMLELNRIANHLLWLGPFLADVGAQTPFFYIFRERELIYDLWEAATGQRLINNNYFRIGGVAADLPYGWLEKCIDFCDYFQAKVDEYERLITDNPIFRRRVEGIGVISREEALNWSLSGPMLRGSGVKWDLRRVDHYECYDDFDWDVITAEEGDCFARYRVRVQEMRESLKIIRQACAGIPGGPYENLEARRMAEGKKSEWYGPDYQYVSKKVAPTFKIPAGEHYVRLESGKGELGVFIQGADDICPWRFKIRAPDFNNLQILPQLLQGVKVADIMAILGSIDVIMGSVDR

SEQ ID NO: 67414 - protein, 339 aa, Synechococcus elongatus PCC 6301
MTIRVAINGFGRIGRNFLRCWFGRQNTDLEVVAINNTSDARTAAHLLEYDSVLGRFNADISYDENSITVNGKTMKIVCDRNPLNLPWKEWDIDLVIESTGVFVTAEGASKHIQAGAKKVPITAPGKGEGVGTYVIGVNDSEYRHEDFAVISNASCTTNCLAPVAKVLHDNFGIIKGTMTTTHSYTLDQRILDASHRDLRRARAAAVNIVPTTTGAAKAVALVIPELKGKLNGIALRVPTPNVSVVDLVVQVEKPTITEQVNEVLQKASQTTMKGIIKYSDLPLVSSDFRGTDESSIVDSSLTLVMDGDLVKVIAWYDNEWGYSQRVVDLAELAARKWAA

SEQ ID NO: 67415 - protein, 375 aa, Rhizobium leguminosarum bv. viciae 3841
MDVRAAVAVQAGKPLEVMTVQLEGPKAGEVLVEVKATGICHTDDFTLSGADPEGLFPAILGHEGAGIVVDVGPGVTSVKKGDHVIPLYTPECRECYSCTSRKTNLCTSIRSTQGQGVMPDGTSRFSIGKDKIHHYMGCSTFSNFTVLPEIALAKVNPDAPFDKICYIGCGVTTGIGAVINTAKVEIGATAIVFGLGGIGLNVLQGLRLAGADMIIGVDINPDRKAWGEKFGMTHFVNPKEVGDDIVPYLVNLTKRHGDLIGGADYTFDCTGNTKVMRQALEASHRGWGKSIIIGVAGAGQEISTRPFQLVTGRNWMGTAFGGARGRTDVPKIVDWYMQGKIQIDPMITHTMPLEDINKGFELMHKGESIRGVVVY

SEQ ID NO: 67416 - protein, 1134 aa, Oryza sativa (indica cultivar-group)
MAPLCCCLLRARRLLFSFFFFAVVVVLFSSVSVAQIPVWSCGSVSEMVRNAWAGFQSIDCGGSGNYTDEVGLEWTGDEAYVGGGAGTTASISSMSGQGRRPYRTVRYFPADGRKYCYRVSVRARTRYLVRASFLYGNFDGSRVFPEFDLYVGASRWSTIVIYDESKVVTREMVALAQSGSSSLSVCLANATTGHPFISTLELRPLNASLYHTAFEAAFFLSLAARINFGAPTADPVRYPDDPYDRVWESDMARRPNFLVDAAPGTIRVATDNPVFVASGERPPQKVMQTAVVGTLGALTYRLDLNGFPGSGWACSYLAEIEDDAAATARRFKLYIPGLPEVSKPTVDIGENAPGKYRVYQPGYDNISLPFVLPFAFRKTDDSARGPILNAMEIYSYIPILPASPDAVAMDAPGGALPAAAQLGAGGRRPVCSRTLVLAHMHLIQSHRHVRNNLTGAIPPELAALPCLQEILLDNNMLTGPIPDLSACTNLTVIHLENNQLEGSVPSYLSGLPKLSELYLENNRLSGVIPRALLSRSIVFKYSGNKHLRVGKQEEEERNVVIGICALVGIGLLLAAALCYAYNVSVSGRKQQGASAGGNSKSKSIVVSAEQKKKATPVAAAGGGIDNMMAAMAARGPLEFKVRELEEATSKFARKIGSGGFGVVYYGRLGDGREIAVKDTPPQPGGVPGLLLGAPQQQLHAGVRVHAQWQPQGAAADDEHELAPAAAGGGGRGQGDRVPALRLHAGQSSTGTSRPANILLDAHMRAKVSELGLSKSTEATNSTAYTITTHVRATLGYLDPHYYVSQQLTHKSDLYSFGIILLELISGRPPILLTPGAGAMASLGPWAKSHYESGDIEAIVDPSLRGRYRDVHSVWKVAETAVRCIDADPQGRPSMPEVVKDIQEAIALEMPSSESERPAASFFSPGAGAAGARSSATVRSHDLVMDNLIATHSQRHTSMSSRRGGESGSGDSPRQWEEAKSTTPRLQPGSAGGRSAAPSAEMSSRGWGESGGGDSPQLQGDSSSCKKAKSQTPSLQPGSASEHVAASSATSVETGLEFGKVDGEAHAPRSPALGKATKALNRRAVAGGLDLDTKRSGVEIQKSKVGGLDLLVGNGFFLFYMKAVWMLVDTGDKIL

SEQ ID NO: 67417 - protein, 208 aa, Oryza sativa (indica cultivar-group)
MLLLVLALLGITVFGLAVTAGGGGTQVAGRPYREFRLADYSSWLQRHVRAERYWRPALACVLAARACDTLAAWTPLDYLRNDLTPVQSGCCKPPTACTYYDDAQQQQQQPDCYRWSNAPGVLCYGCDSCKAGVLEQLRRHWHNVTILNVVLLLLLILFYSCACCAFRNTATATSSKTIFHLHPRWEYRWYLLYLCARESQGGGMDEDS

SEQ ID NO: 67418 - protein, 142 aa, Pseudomonas putida KT2440
MWGSWSAYEPMPGLLRLLEHAQAHGIGMCVVTNAPRLNAEHMLNAMGLGQHFEHVLVAEELARPKPDPLPYLTGLQRLGVEAGQALAFEDSLPGTAAASGAGIFTVGVATTQTPERLLAAGARLVVDDFNDAALWALIERMA

SEQ ID NO: 67419 - protein, 473 aa, Bacillus cereus G9241
MMDQNQGLKRELKSRHIFMIALGGVIGTGLFLGSGYTIHEAGPGGAIVAYLVGGFVMYLTMLCLGELAVAMPDAGSYQTYATKHISPAAGYVVGWMSWLNWSATIGIELIAVSILMKRWFPDVPSWIWCVVFAALLFAINALSSRSFAEVEFWFASIKVITIIAFIILGGAAMFGFLDMKGNEPAPMFSSFTDYGGLFPNGLSAILITMIAVNFSFQGTELVGIAAGESENPEKTIPKAINNTVWRILVFFVLSIFILAGLFPWQQAGVIESPFVVVFDKIGIPYAADIINFVIITAVLSVANSGLYATSRMLWSMSNQGMISPIFGKLSKNGVPIYALIVSTIVGCLSLLSGIYAEDTVYLWLLSIAGFGAILVWASIALSNLLARRSYIKQGGDVKDLKFKTPLYPFVPLLALVLNVTVIVGMAFIPEQRMALYCGIPFMIVCLLFYRATRNKGSNLEHIEKTKTTEIESL

SEQ ID NO: 67420 - protein, 364 aa, Ralstonia eutropha JMP134
MSADNQLQFTVERHPNPTPADKIAAALVDPAFGRVFTDHMVTIRWTEGRGWHDAKVEARRPFQIDPACAVLHYAQEIFEGMKAYRGADGKISLFRPQENAKRFRASAARMSMADLPEAEFLRAVEALVDIDRDWIPGGDGSLYLRPFMFAAENFLGVRAANEYVFCVIACPVGPYFKGGKSAVTVWVSDQYTRAAPGGTGAAKCGGNYAASLIAQTEAAQKGCDQVVFLDAAEHRWIEELGGMNVFFVMDDGSLLTPPLSGTILPGITRASVIELARHEGIKVSETPYAFEAWQADAASGRVKETFACGTAAVVTAIGTVRHAGGEFNIGNGGEGEVTKRLRALLTGIQRGKEADTFGWVHHIA

SEQ ID NO: 67421 - protein, 319 aa, Ralstonia solanacearum GMI1000
MTQLDQLKQFTTVVADTGDFQAMRAYAPHDATTNPSLILKAVQKAEYRPLLEQAVRDARSDSVEDIIDAVLVAFGCEILSIIPGRVSTEVDARLSFDTAATVAKARHLIALYEARGVPRERVLIKIASTWEGIRAADQLRAEGIRCNMTLLFSLIQAVACAEAGVQLISPFVGRIYDWYKKDAGAAWDPIAQGGANDPGVQSVVRIYNYYKRFGYTTEVMGASFRNTSQIIELAGCDLLTISPELLAQLQQSDAPVERKLSPEHAHATNLVRLPADEAAFRWHMNADAMATEKLAEGIRLFAADAVKLEGLIGPLRAAA

SEQ ID NO: 67422 - protein, 228 aa, Ralstonia solanacearum GMI1000
MTQDELKALVAQAAADYVLANVPEGAVLGVGTGSTANLFIDAMAPHKARFAGAVSSSEASTRRLQGHGFAVLDLNEVDTIPVYVDGADEIDDTGAMIKGGGGALTREKIVASVAGRFVCIADGSKLVDVLGAFPLPVEVVPMARAAVARQLAALGGQPRLRMTKEGQIYQTDNGNVILDVSGLRIGEPKTLEAQINDIPGVVTVGLFAKRGADVLLLGTEAGVQRRDF

SEQ ID NO: 67423 - protein, 164 aa, Oryza sativa (japonica cultivar-group)
MENYQGQHGYGADRVDVYGNPVAGQYGGGATAPGGGHGVMGMGGHHAGAGGQFQPVKEEHKTGGILHRSGSSSSSSSSEDDGMGGRRKKGIKEKIKEKLPGGNKGNNQQQQQMMGNTGGAYGQQGHAGMTGAGTGTGVHGAEYGNTGEKKGFMDKIKEKLPGQH

SEQ ID NO: 67424 - protein, 379 aa, Brassica oleracea
  misc_feature (86)..(86): Xaa can be any naturally occurring amino acid
  unsure (1)..(379): unsure at all Xaa locations
MSTTGQIIRCKAAVCWEAGKPLVMEEVEVAPPQKHEVRIKILFTSLCHTDVYFWEAKGQTPLFPRIFGHEAGGIVESVGEGVTDLXPGDHVLPIFTGECGDCPHCHSEESNMCDLLRINTERGGMIHDGESRFSINGKPIHHFLGTSTFSEYTVVHSGQVAKINPEAPLDKVCIVSCGLSTGLGATLNVAKPKKGQSVAIFGLGAVGLAAAEGARIAGAGRIIGVDLNPKRFEEAKKFGVTEFVNPKEHDKPVQEVIAEMTNGGVDRSVECTGSIQAMIQAFECVHDGWGVAVLVGVPSKDDAFKTHPMNLLNERTLKGTFFGNYKPKTDIPGVVEKYMNKELELEKFITHTVPFSEINKAFDYMLKGESIRCIITMGA

SEQ ID NO: 67425 - protein, 379 aa, Capsella rubella
  misc_feature (376)..(376): Xaa can be any naturally occurring amino acid
  unsure (1)..(379): unsure at all Xaa locations
MITTGLFIRCKAAVSWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNPSRFDQAKKFGVTEFVNPKDHDKPVQQVIAEMTNGGVDRSVECTGSVQAMIQAFECVHDGWGVAVLVGVPSKDDAFKSHPMNFLNERTLKGTFFGNYKPKTDIPGVVEKYMNKELELEKFITHTVPFSEINKAFDYMLKGESIRCIIXMGA

SEQ ID NO: 67426 - protein, 186 aa, Coprinopsis cinerea okayama7#130
MVLVLVIGDLHIPHRTHDLPLKFKKLLVPGKIQQILCTGNVCDKETYDYLRTISPDVHVVKGDYDESSAFPSSVTVMHNAIKIGVIHGHQCVPVGDLDSLGAIARQMDVDVLISGHTHTDPTPSFALMDIQGNVVVTYVYQLIEGEVRVEKIEWRKEPESVANAPRSTVMPQSIPSPSPSSPQEGW

SEQ ID NO: 67427 - protein, 399 aa, Candidatus Pelagibacter ubique HTCC1002
MSIISDSLKKIKPSPTIAVTQKARELKAAGKDVIGLGAGEPDFDTPDNIKQAAIKAINDGDTKYTAVDGTAALKDAIVKKFKRENNLDYTTDQITVGAGGKHVIYNAMMATLNEGDEVIVPAPYWVSYPDMVLLAGGTPIILECNEKQGFKINPAKLEKSITPKTKWIILNSPSNPTGACYTESDIKEIAYVLANHPHVHILSDDIYEHVTYEGFKFFTIAQIDGLKERVLTMNGVSKAYSMTGWRIGYAAGPKDIIKAIAKIQSQSTTNPSSISQAAAVEALNGTQDFIKERATSFQERRNFVVKALNGIDGIECLNPDGAFYVFPSCKGLMGKKDTSGKELKTDTDFVQSLLENSGVAVVQGSAFGLEGFFRISYATSMDNLKKALEKISTFCKSLN

SEQ ID NO: 67428 - protein, 379 aa, Boechera stricta
MSTTGQIIRCKAAVAWEAGKPLVMAEVEVAPPQKHEVRIKILFTSLCHTDIYFWEAKGQTPLFPRIFGHEAGGIVESVGEGVTDLQPGDHVLPVFTGECGDCRHCHSEESNMCDLLRINTERGVMIHDGESRFSINGKPIYHFVGTSTFSEYTVVHSGQVAKINPDAPLDKVCIVSCGLSTGLGATLNVAKPKKGQSVAIFGLGAVGLAAAEGARIAGAFRVIGVDLNPKRFDEAKKFGVTEFVNPKDHDKPVQQVIAEMTDGGVDRSVECTGSVQAMIQAFECVHDGWGVAVLVGVPSKDDAFKSHPMNFLNERTLKGTFFGNYKPKTDIPGIVEMYMNKELELEKFITHTVPFSGINKAFDYMLKGESIRCIIPMGA

SEQ ID NO: 67429 - protein, 650 aa, Ralstonia solanacearum GMI1000
MSPLNFPSDRPIDLACLGRVAVDLYAQQIGSRLEDARSFQMYLGGSSGNVAFGVARLGLKTAMISRVGDEQMGRFLRETLEREGCDTSQLQTDPERLTALVLLGLKDRDTFPLLFVRENCADMAVRADGIDEGFIAGCRALAITGTHLSTPTTREASLTALAYARRHGAVRILDIDYRPVLWGLTSRGAGEHRYVPDAHVTRQLQQALGEFDLLVGTEEEFLIAGGVPRDLMASLRAVRQISGAVLVVKRGALGCCVIEGAVPERIEDAPTFPGERVEVLNVLGAGDAFLSGLLSGLLRGKGWAESARIANACGAIVVSRHACSAAMPTPAELAHWFGGSRHPGVDADRELAHLHRVTVARPHWDDLCVMAFDHRSQFYDLAVQAGAGESRIKTLKQLLVRAAEQVERERALHGHVGVLIDGGAYGSDALASATGRGWWVGRPVELPGSRPLRFDDTRSVGSALIHWPTEQVVKCLVHYHPDDPATLRVDQEQKVLELWEATRESGNELLLEIIPPRPFTLAGTEDDAVLRTVARVYNLGVRPEWWKLAPMSADGWTQLEALITERDAHCRGAVILGLNQPLQYLVDSFRSATNPIVKGFMVGRTLWADASLKWLRGDISDQAFIDEVAGNFAQLADAWLGRRADARSAA

SEQ ID NO: 67430 - protein, 479 aa, Erwinia carotovora subsp. atroseptica SCRI1043
MSTTQKRMYINGEFVENRSGKWIDVVNPATEQVISQVPEGSADDAKRAIDAAEAAQPSWEALPAVERGVWLHKIAAGIREREAELTDTIIAEGGKTHGLAQTEVLFTADYLDYMAEWARRYEGEIIQSDRPNENIFVFRKAIGVTTGILPWNFPFFLIARKAAPALITGNTIVIKPSEITPNNAVIFAEIIHKIGLPKGVINFVTGYGPTVGQELAGNPKVGMVSLTGSVAAGIATMTAAAQNVTKVSLELGGKAPAIVMDDADLDLAVKAIVSSRVINSGQVCNCAERVYVQKGIYDEFIIRIKAAMEQVTFGNTAEKKTLDMGPLISAAALQRVEDKVAKAVSQGAKVLLGGKSESGTGYFYPPTLLVNVTQEMPIMHEEVFGPVLPVATFDTLEDAIAMANDSEYGLTSSIYTQNINTAMKALKGLKFGETYINRENFEAMQGFHAGWRKSGVGGADGKHGLQEYLQTHVAYLQFH

SEQ ID NO: 67431 - protein, 379 aa, Boechera stricta
  misc_feature (366)..(366): Xaa can be any naturally occurring amino acid
  unsure (1)..(379): unsure at all Xaa locations
MITTGQIIRCKAAVAWEAGKPLVMEEVEVAPPQKHEVRIKILFTSLCHTDVYFWEAKGQTPLFPRIFGHEAGGIVESAGEGVTDLQPGDHVLPVFTGECGDCRHCHSEESNMCDLLRINTERGVTIHDGESRFSINGKPIHHFVGTSTFSEYTVVHSGQVAKINPDAPLDKVCIVSCGLSTGLGATLNVAKPKKGQSVAIFGLGAVGLAAAEGARIAGASRVIGVDLNPKRFDEAKKFGVTEFVNPKDHDKPVQQVIAEMTDGGVDRSVECTGSVQAMIQAFECAHDGWGVAVLVGVPSKDDAFKSHPMNFLNERTLKGTFFGNYKPKTDIPGIVEMYMNKELELEKFITHTVPFSEINKAFDNMXKGESIRCIITMGA

SEQ ID NO: 67432 - protein, 475 aa, Thermoanaerobacter tengcongensis MB4
MANSTSSYLWRKKTLEMVLSETEAEQFKLKKTLTAIDLIALGIGAIIGTGIFVITGVAAAEKAGPAIVLSFILAGLACAFAAISYAELASMFPIAGSTYNYAYIAMGEFLAWIIGWDLILEYVFALPAISLGWSGYFTNLLGSIGINIPAWAANSAWQAPGTGGLINLPAIGILLAIAILNYIGVRETATVNNIGVAFKVFVVLFFIFTAVWYVKPANWSPFLPYGWAGVFHGAAIIFFAYIGFDAVSTAAEETKNPAKDMPIGILGSLGISTLLYIAVSAILTGVVSYTELNDPAPVAKALNLIGLNWARGLVSLGAIVGITTVLLVMFYGSTRIIFAMSRDGLLPPIFSKVHPKYRTPTLAIYLITIATTLVAGFFPIGVIAELVNIGTMLAFVLTSIATIVLRYTQPDLPRKFRAPGMPWTGILAIAFVLSLMVSLPWETWVRLIVWFVIGLFIYFGYGRHNSILAKQQTQH

SEQ ID NO: 67433 - protein, 379 aa, Boechera fendleri
MITTGQIIRCKAAVAWEAGKPLVMEEVEVAPPQKHEVRIKILFTSLCHTDVYFWEAKGQTPRFPRIFGHEAGGIVESVGEGVTDLQPGDHVLPVFTGECGDCRHCHSEESNMCDLLRINTERGVMIHDGESRFSINGKPIHHFVGTSTFSEYTVVHSGQVAKINPDAPLDKVCIVSCGLSTGLGATLNVAKPKKGQSVAIFGLGAVGLAAAEGARIAGASRVIGVDLNPKRFDEAKKFGVTEFVNPKDHDKPVQQVIAEMTDGGVDRSVECTGSVQAMIQAFECVHDGWGVAVLVGVPSKDDAFKSHPMNFLNERTLKGTFFGNYKPKTDIPGIVEMYMNKELELEKFITHTVPFSEINKAFDYMLKGESIRCIITMGA

SEQ ID NO: 67434 - protein, 329 aa, Arabidopsis thaliana
MMRSFVSLISLLLLLSFSSSVLSTKKSSFQKLPVPGNRTGPEAFAFDSTGKGFYTGVTGGKILKYLPKKGYVDFAQITNSSKSSLCDGALGTTNVEKCGRPAGIAFNTKTGDLYVADAALGLHVIPRRGGLAKKIADSVGGKPFLFLDGLDVDPTTGVVYFTSFSSTFGPRDVLKAVATKDSTGKFFKYDPSKKVVTVLMEGLSGSAGCAVSSDGSFVLVGQFTKSNIKRYWIKGSKAGTSEDFTNSVSNPDNIKRIGSTGNFWVASVVNSATGPTNPSAVKVSSAGKVLQTIPLKDKFGDTLVSEVNEYKGQLYIGALFGPFAGILKL

SEQ ID NO: 67435 - protein, 147 aa, Burkholderia xenovorans LB400
MTSVAQLLKTKPNNTTVFTVGADDSVYDAIKLMAEKGIGALVVTDGDSIAGIVTERDYARKVVLLDRSSKATPVRDIMSKAVRFVRPDQTTDDCMALMTERRMRHLPVIENDRLVGMVSIGDLVKNIIAEQQFTIQQLEFYIHGERP

SEQ ID NO: 67436 - protein, 379 aa, Turritis glabra
  misc_feature (6)..(6): Xaa can be any naturally occurring amino acid
  unsure (1)..(379): unsure at all Xaa locations
MITTGXIIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCRHCHSEESNMCDLLRINTERGGMIHDGESRFSINGKPIYHFLGTSTFSEYTVVHSGQVAKINPDAPLDKVCIVSCGLSTGLGATLNVGKPKRGQSVAIFGLGAVGLAAAEGARIAGASRIIGVDLNSKRFDQAKEFGVTEFVNPKDHDKPVQQVLAEMTDGGVDRSVECTGSVQAMIQAFECVHDGWGVAVLVGVPSKDDAFKSHPMNFLNERTLKGTFFGNYKPKTDIPGVVEKYMNKELELEKFITHTVPFSEINKAFDYMMKGESIRCIITMGA

SEQ ID NO: 67437 - protein, 379 aa, Olimarabidopsis pumila
MITTGQIIRCKAAVAWEAGKPLVMEEVEVAPPQKHEVRIKILFTSLCHTDVYFWEVKGQTPLFPRIFGHEAGGIVESVGEGVTDLQPGDHVLPIFTGECGDCRHCHSEESNMCDLLRINTERGGMIHDGESRFSINGKPIHHFLGTSTFSEYTVVHSGQVAKINPDAPLDKVCIVSCGLSTGLEATLNVAKGKKGQSVEIFGLGAVGLAAAEGARIAGASRIIGVDLNSKRFDQAKEFGVTEFVNPRDHDKPVQQGIAEMTDGGVDRSVECTGSVQAMIQAFECVHDGWGVAVLVGVPSKDDAFKTHPMNLLNERTLKGTFFGNYKPKTDIPGVVEKYMNKELELEKFITHTVPFSEINKAFDHMLKEESIRCIITMGA

SEQ ID NO: 67438 - protein, 379 aa, Halimolobos perplexa var. lemhiensis
MSTTGQIIRCKAAVAWEAGKPLVMEEVEVAPPQKHEVRIKILFTSLCHTDVYFWEAKGQTPLFPRIFGHEAGGIVESVGEGVTDLQPGDHVLPVFTGECGDCRHCHSEESNMCDLLRINTERGGMIHDGESRFSINGKPIHHFVGTSTFSEYTVVHSGQVAKINPDAPLDKVCIVSCGLSTGLGATLNVAKPKKGQSVAVFGLGAVGLAAAEGARIAGASRIIGIDLNPKRFDEAKKFGVTEFVNPKDHDKPVQQVIAEMTDGGVDRSLECTGNVQAMIQAFECVHDGWGVAVLVGVPSKDDAFKSHPMNFLNERTLKGTFFGNYKPKTDIPGIVEMYMNKELELEKFITHTVPFSEINKAFDYMLKGESIRCIITMGA

SEQ ID NO: 67439 - protein, 303 aa, Rhizobium leguminosarum bv. viciae 3841
MKFEGIYTPAVTPLDQNGQIDRAGFAAVLESLIEAGVHGIIVGGSTGEYYAQSSQERFELAAYAREVIGTRLPLIIGTGATRTEDSVEYAKAAKEIGADAILVSSPPYALPTERENAVHALTVDRAANLPIMLYNYPARMGVMMGEEYFSRLGKSRNVIAIKESSGDMGNLHLLARKFPHIALSCGWDDQALEFFAWGAKSWVCAGSNFLPREHVALYEACVLEKNFDKGRAIMMAMLPLMDFLECGKFVQSIKHGCELIGLNVGSVRAPLRPLNSEEKRTLQTVVATLKRTVAQITSGVNHA

SEQ ID NO: 67440 - protein, 379 aa, Arabidopsis halleri
MITTGQSIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 67441 - protein, 379 aa, Arabis hirsuta
MITTGQIIRCKAAVAWEAGKPLVMEEVEVAPPQKHEVRIKILFTSLCHTDVYFWEAKGQTPLFPRIFGHEAGGIVESVGEGVTDLAPGDHVLPVFTGECGDCPHCHSEESNMCDLLRINTERGGMIHDGESRFSIDGKPIYHFVGTSTFSEYTVVHSGQVAKINPDAPLDKVCIVSCGLSTGLGATLNVAKPKKGQSVAIFGLGAVGLAAAEGARIAGASRIIGVDLNSKRFDEAKKFGVTEFVNPKDHDKPVQQVIAEMTNGGVDRSVECTGSVQAMIQALECVHDGWGVAVLVGVPSKDDAFKTHPMNLLNERTLKGTFFGNYKPKTDIPGVVEKYMNKELELEKFITHTVPFSEINKAFDYILKGESIRCIITMGA

SEQ ID NO: 67442 - protein, 505 aa, Rhizobium leguminosarum bv. viciae 3841
MHEPLTASEYKAIAAGLQFPTNAFIDGAFRPANSGQTFTSTNPATGEVLAEIAACDATDVDAAVSKAKQAFDDGRWRLRSPGERKAVLLKLARLLEDNRHELAVMESLDSGKPVGECQTVDVPDTIHTIRWHAELIDKLYDNTAPVGANALTMIVREPVGVVGCVLPWNFPLLMLAWKIGPALAAGCSVIVKPAQETTLTTLRVAELAHEAGIPAGVFNVVTGGGKEVGEPIGMHMDVDMVAFTGSTPTGRRFLRYAADSNLKRVVLECGGKNPAVVLDDAEDLDLVAEQVVNGAFWNMGENCSATSRLIVHSKVKDELLKRIGAYMREWKTGDPLDPANRIGALVSKAHFEKVKSFLDDARKEKLTVTHGGETHGGIFIEPTVVEGVTPASRLFQEEIFGPVLSVTTFNSLAEAIALANDTNYGLTASVYTGSLRNAIKLSREIRAGVVTVNCFGEGDASTPFGGYKESGFGGRDKSVFAHDNYCELKTIWIDVSERSVDETIR

SEQ ID NO: 67443 - protein, 198 aa, Campylobacter jejuni RM1221
MIISAKFITSLVKFDENLSSNFSEVAFLGRSNVGKSSLINSLCKQKNLAKSSATPGKTQLINFFEVICKRNEEKFNINFIDLPGFGYAKVSKNLKEIWNQNLDEFLKLRTSIKLFIHLIDSRHTHLEIDVNLNDYLKRFLRPDQKILKVFTKCDKLNQSEKAKLKNEFKDSILVSNLNKFGLDSLEDIIINQTLGLDK

SEQ ID NO: 67444 - protein, 479 aa, Myxococcus xanthus DK 1622
MDAKGLRTFLEIPYDELEERNLKVKEQRLKHTASEKLRDERIEYLTKERAIKAVTVCFTDLEGRLHMLDYDKKFLIKSADNLTFDGSSIRGFSAQQESDLRLNIDWSAFYWLPSDIFGPGKVLVFSEVHERDGTQYHSDLRGRLKLLTESMYQKDGTVVHAAPEIEGFLFKGRDAEHHFHEKGHFDFISTGGYYHSLPGDVLRTFIDKVAEAQRAMGFQNEKDHPEVAPSQFEINFSYSEALIAADQIQLYKLLSRQVAAQLDCTASFLPKPVTGVNGNGMHMNLSLSKGGKNLFHDQNGPDGLSPMGWDFIDRLLTSANDICLTLNSSVNAYRRLDPHFEAPNQIKASANNRGAMVRIPFGNERSARIECRSVAPDANPYLVLYTLLRTGLEGPQPQEDAEAKRSRTRFLPDNIFDAIRIFKGSQFVASILGEGVQSKFAELKTTTAERSPKQLGTRVKYSEVKFHHEVTNQFLWNQF

SEQ ID NO: 67445 - protein, 297 aa, Corynebacterium diphtheriae NCTC 13129
MTQETFTATTRVKRGLADMLKGGVIMDVVTPEQARIAEDAGASAVMALERVPADIRAQGGVARMSDPDLIEGIVNAVSIPVMAKARIGHFVEAQILESLGVDFIDESEVLSPADYVNHIDKWNFDVPFVCGATNLGEALRRITEGAAMIRSKGEAGTGDVSEAVKHLRTIRGEINRLRSMDEDQLYVAAKEIQAPYDLVREVAATGKLPVTLFVAGGVATPADAALVMQMGAEGVFVGSGIFKSGNPAARAAAIVKATTMYDDPAAIAEVSRGLGEAMVGINVADVPAPHRLAERGW

SEQ ID NO: 67446 - protein, 384 aa, Oryza sativa
MAETKIEGPTIAVKLFVDKERSRVLFAESDKDFVDVLFGFLTLPLGTVVRLLGRQSQVGCLDELYKSVEDLSADYFHTKACKAMLMKPHDTAAEQCCLLKVKVDDTDQSAVYVCRDANCSANGDCGVTSVAGSVCKCGKVMEYIGEWPQDGGSTAAAGSDGGVFVKGCYKFIVTDDLHVAPAATSLMMSIFDKYGVRDPANLEQKILQLNAEKITCLLKRSLTSKQTLTGYYFDVPNPNDEANLYVLPESLYSEQDAEVDHKLNNMKIKVLQRKNNTSLLYAEVGEDFVDLLFGLLSIPLGSILKTYGKWSSNGCVDNIYMSIDGSAKGCMNPERQMLLASPNVASFFGCSATNMLIQLGEAAPKQRNISGCFKCFKIAGFWPL

SEQ ID NO: 67447 - protein, 376 aa, Zea mays
MGASGKWIKSLVALKAPEKAAGHKGGRKWRLWRSSSATSRASAGEGSALASESSSASADSFNSVLAAVVRAPPRDFLLIRQEWAAVRIQTAFRGFLARRALKALRGIVRLQALVRGRRVRKQLAVTLKCMHALLRVQERARERRARSSADGHGSQGQDALNGCASSTKDAMEQWCDRHGSVAEDFSYLDGWMATKPWETRSTERNHSDSQLAKHCEEPNLPASKLSDASSVKIRRNNVTTRVSAAKRPPPSSVLSAASSDSAYGDKSPRSRPSVTLTSATTNTVLASEARSDSGDTGGPNYMSLTKSAKARLSGCSGSSHHRSFQRPRSGDMSRVTLSSIDTQSNAGSEISVTSKRLNSMSLNLKGRSLDKENEED

SEQ ID NO: 67448 - protein, 309 aa, Bacillus cereus G9241
MQCIETNNLQQLLEQVKPYTKKGKLATYIPELGNANPDDLGIAIFHKETEYIHAGNSQTLFTLQSISKVITLALALLDRGEEYVFSKVGMEPTGDPFNSIIKLETTSPSKPLNPMINAGALAITSMLAGKDNEEKMDRILHFVREITDNPTINYSSKVANSELETAYLNRSLCYYMKQNGIIDCDIEELMDLYTRQCAVEVNCIDLARIGLIFAMDGYDPYKEKQIIPKHITKICKTFMVTCGMYNESGEFAIRVGIPAKSGVAGGIFGCVKGEMGIGIFGPALDANGNSIAGFKILELLSAQEGWSIF

SEQ ID NO: 67449 - protein, 456 aa, Saccharomyces cerevisiae
MSDKPIDIQYDKQATPNLSGVITPPTNETGNDSVREKLSKLVGDAMSNNPYFAAGGGLMILGTGLAVARSGIIKASRVLYRQMIVDLEIQSKDKSYAWFLTWMAKHPQRVSRHLSVRTFYIQHDNGSVSTKFSLVPGPGNHWIRYKGAFILIKRERSAKMIDIANGSPFETVTLTTLYRDKHLFDDILNEAKDIALKTTEGKTVIYTSFGPEWRKFGQPKAKRMLPSVILDSGIKEGILDDVYDFMKNGKWYSDRGIPYRRGYLLYSPPGSGKTSFIQALAGELDYNICILNLSENNLTDDRLNHLMNNMPERSILLLEDIDAAFNKRSQTGEQGFHSSVTFSGLLNAQDSVTSSEETITFMTTNHPEKLDAAIMRPGRIDYKVFVGNATPYQVEKMFMKFYPGETDICKKFVNSVKELDITVSTAQLQGLFVMNKDAPHDALKMVSSLRNANHIF

SEQ ID NO: 67450 - protein, 413 aa, Pyrococcus horikoshii
MGGGNLNIEEIIEKVANGEIKFYQVEKYVNGDKRLATEIRRKALEKRLGIKLHHIGYYSIDPNELIGRNIENMIGVVQIPMGVAGPLKINGEYAKGEFYIPLATTEGALVASVNRGCSALTEAGGVVTTLIDDKMTRAPLIRCPNARRAREVAKWVEENLDYLQEKAVSKVTRHGKLRGVKPFIVGNNLYLRFEFETGDAMGMNMVTIASEEIMKVIEEEFPDVRYLALSGNLCVDKKPNAVNFILGRGKTVIAEAVVPRKIVEKKLKTTPELIAEVNYFKNLVGSAQAGSYGFNAHFANIVGAIFLATGQDEAQITEGAHGITIAEVTPDGDLYISITMPSLEIGTVGGGTRVPSQREALEIMGVAGGGDPPGINAKKFAEIVAGAVLAGELSLLAAIAAKHLARAHKMLGR

SEQ ID NO: 67451 - protein, 379 aa, Arabis hirsuta
  misc_feature (183)..(183): Xaa can be any naturally occurring amino acid
  misc_feature (372)..(372): Xaa can be any naturally occurring amino acid
  unsure (1)..(379): unsure at all Xaa locations
MITTGQIIRCKAAVAFEAGKPLVMEEVEVAPPQKNEVRIKILFTSLCHTDVYFWEAKGQTPLFPRIFGHEAGGIVESVGEGVTDLAPGDHVLPIFTGECGDCPHCHSEESNMCDLLRINTERGVMINDGESRFSIDGKPIYHFVGTSTFSEYTVVHSGQVAKINPDAPLDKVCIVSCGLSTGXGATLNVAKPKKGQSVAIFGLGAVGLAAAEGARIAGASRIIGVDLNSKRFDEAKKFGVTEFVNPKDHDKPVQQVIAEMTDGGVDRSVECTGSVQAMIQAFECVHDGWGVAVLVGVPSKDDAYKTHPMNFLNERTLKGTFFGNYKPKTDIPGLVEKYMNKELEIEKFITHTVPFSEINRAFDYMLKGEGIXCKITMGA

SEQ ID NO: 67452 - protein, 379 aa, Arabis hirsuta
  misc_feature (317)..(317): Xaa can be any naturally occurring amino acid
  unsure (1)..(379): unsure at all Xaa locations
MSTTGQIIRCKAAVAWEAGKPLVMEEVEVAPPQKNEVRIKILFTSLCHTDVYFWEAKGQTPLFPRIFGHEAGGIVESVGEGVTDLAPGDHVLPIFTGECGDCPHCHSEESNMCDLLRINTERGVMINDGESRFSIDGNPIYHFVGTSTFSEYTVVHSGQVAKINPDAPLDKVCIVSCGLSTGLGATLNVAKPKKGQSVAIFGLGAVGLAAAEGARIAGASRIIGVDLNSKRFDEAKKFGVTEFVNPKDHDKPVQQVIAEMTDGGVDRSVECTGSVQAMIQAFECVHDGWGVAVLVGVPSKDDAFKTHPMNFLNERTXKGTFFGNYKPKTDIPGLVEKYMNKELEIEKFITHTVPFSEINKAFDYMLKGEGIRCIITMGA

SEQ ID NO: 67453 - protein, 379 aa, Arabis soyeri subsp. subcoriacea
MITTGQIFRCKAAVAWEAGKPLVMEEVEVAPPQKHEVRIKILFTSLCHTDVYFWEAKGQTPLFPRIFGHEAGGIVESIGEGVTDLAPGDHVLPIFTGECGDCPHCHSEESNMCDLLRINTERGGMIHDGESRFSINGKPIHHFVGTSTFFEYTVVHSGQVAKIIPDAPLDKVCIVSCGLSTGLEATLNVAKPKKGQSVAIFGLGAVGLAAAEGARIAGASRIIGVDLNSKRFDEAKKFGVTEFVDPKDHDKPVQQVIAEMTDGGVDRSVECTGSVQAMIQAFECVHDGWGVAVLVGVPSKGDAFKTHPMNFLNERTLKGTFFGNYKPKTDIPGVVEKYMNKELELEKFITHTVPLSEINKAFDYMMKGESIRCIITMGA

SEQ ID NO: 67454 - protein, 379 aa, Boechera lignifera
MSTTGQIIRCKAAVAWEAGKPLVMEEVEVAPPQKHEVRIKILFTSLCHTDVYFWEAKGQTPLFPRIFGHEAGGIVESVGEGVTDLQPGDHVLPVFTGECGDCRHCHSEESNMCDLLRINTERGVMIHDGESRFSINGKPIYHFVGTSTFSEYTVVHSGQVAKINPDAPLDKVCIVSCGLSTGLRATLNVAKPKKGQSVAIFGLGAVGLAAAEGARIAGASRVIGVDLNPKRFDEAKKFGVTEFVNPKDHDKPVQQVIAEMTDGGVDRSVECTGSVQAMIQAFECVHDGWGVAVLVGVPSKDDAFKSHPMNFLNERTLKGTFFGSYKPKTDIPGIVEMYMNKELELEKFITHTVPFSEINKAFDYMLKGESIRCIITMGA

SEQ ID NO: 67455 - protein, 176 aa, Salmonella typhimurium LT2
MAGESYILMGVSGSGKSLIGSKIATLFSAKFIDGDDLHPAKNIDKMSQGIPLTDEDRLPWLERLNDASYSLYKKNETGFIVCSSLKKQYRDILRKSSPNVHFLWLDGDYATILQRMQRRAGHFMPPDLLQSQFDALERPCADEHDIARIDVNHDIEHVTEQCRLAVQAFRQALSAS

SEQ ID NO: 67456 - protein, 379 aa, Boechera lyallii
MSTTGQIIRCKAAVAWEAGKPLVMEEVEVAPPQKHEVRIKILFTSLCHTDVYFWEAKGQTPLFPRIFGHEAGGIVESVGEGVTDLQPGDHVLPVFTGECGDCRHCHSEESNMCDLLRINTERGVMIHDGESRFSINGKPIHHFVGTSTFSEYTVVHSGQVAKINPDAPLDKVCIVSCGLSTGLGATLNVAKPKKGQSVAIFGLGAVGLAAAEGARIAGASRVIGVDLNPKRFDEAKKFGVTEFVNPKDHDKPVQQVIAEMTDGGVDRSVECTGSVQAMIQAFECVHDGWGVAVLVGVPSKDDAFKSHPMNFLNERTLKGTFFGNYKPKTDIPGIVEMYMNKELELEKFITHTVPFSEINKAFDYMLKGESIRCIITMGA

SEQ ID NO: 67457 - protein, 211 aa, Zea mays
  misc_feature (93)..(93): Xaa can be any naturally occurring amino acid
  unsure (1)..(211): unsure at all Xaa locations
MASHDHHHSHSHDDHHHHSHGDGGGHAAGGSWVGEDGRVWHSHDGLAPHSHEPIYSPGDFTKRAPPLASRDFADRAFTVGIGGPVGTGLIWVXKTALMLALCRFLRDKYSLAAVTNDIFTKEDGEFLIKHGALPEERIRAVETGGCPHAAIREDISINLGPLEELSNLYKADLLLCESGGGIFFYLIQNKCRSFLLLCMLESTPERQPCRL

SEQ ID NO: 67458 - protein, 1129 aa, Petroselinum crispum
MSSSRPANSSSNPGRANQNARVVLTTLDAKIHADFEESGNSFDYSSSVRVTSAVGENSSIQSNKLTTAYLHHIQKGKLIQPVGCLLAVDEKSFKIMAYSENAPEMLTMVSHAVPSVGEHPVLGIGTDVRTIFTAPSAAALQKAVGFTDINLLNPILVHCKTSGKPFYAIAHRVTGSLIIDFEPVKPYEVPMTAAGALQSYKLASKAVNRLQALPGGSMERLCDTMVQEVFELTGYDRVMAYKFHDDDHGEVTAEVTKPGLEPYFGLHYPATDVPQAARFLFLKNKVRMICDCRANSAPVLQDEKLPFELTLCGSTLRAPHSCHLQYMENMNSIASLVMAVVINDSDEVVESSDRNSVKSKKLWGLVVCHNTSPRFVPFPLRYACEFLAQVFAIHVSKELELENQIVEKNILRTQTLLCDLLMRDAPLGIVSQSPNMMDLVKCDGAALLYKNKVYRLGATPSDYQLRDIVSWLTEYHTDSTGLSTDSLYDAGYPGALALGDVVCGMAVVKITSHDMLFWFRSHAAGHIRWGGAKAEPDENHDGRKMHPRSSFKAFLEVVKTRSTTWKEFEMDAIHSLQLILRKALSVEKAVAAQGDEIRSNTDVIHTKLNDLKIEGIQELEAVTSEMVRLIETATVPIFAVDADEIVNGWNTKIAELTGLPVDQAMGKHLLTLVEDSSVGTVVFLLALALQGKEEQGIPFEFKTYGSREDSVPITVVVNACATRGLHDNVVGVCFVAQDVTSQKTIMDKFTRIQGDYKAIVQNPNPLIPPIFGTDEFGWCSEWNQAMTELSGWRREDVMNKMLLGEIFGIQTSCCHLKSKEAFVNLGVVLNNALTGQISEKICFSFFATDGKYVECLLCASKKLHGEGTVTGIFCFLQLASQELQQALHIQRLTEQTAMKRLKTLSYLRRQAKNPLCGINFVREKLEEIGMGEEQTKLFRTSVHCQRHVNKILDDTDLDSIIDGYLDLEMSEFRLHDVYVASRSQVSMRSNGKAIQVVDNFSEEMMSETLYGDSLRLQKVLADFMSVCVNLTPVGGHLGISVTLTEDNLGQSVQLVHLEFRITHTGAGVPEEAVSQMFGSDSETSEEGISLLISRKLVKLMNGDVHYLREAGKSTFIITVELAAASKRES

SEQ ID NO: 67459 - protein, 379 aa, Arabidopsis lyrata subsp. lyrata
  misc_feature (374)..(374): Xaa can be any naturally occurring amino acid
  unsure (1)..(379): unsure at all Xaa locations
MITTGQIIRCKAAVAWVAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGGTLNVVKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTLPFSEINKAFDYMLKGESIRCXIPMGA

SEQ ID NO: 67460 - protein, 1115 aa, Ipomoea nil
MENYGKAVTFSSSATSNLNTGKAIAQYNADAKLMAEFEQSRESGKSFDYSRSVIHAPQNVTEEEMTAYLSRIQRGGLIQPFGCMLAIEEPSFKIVGFSENCFDLLGLKSGVEPPERMSLIGIDARTLFTLSSRASLAKAVASREISLLNPIWVHSKINQKPFYAVLHRIDVGIVIDLEPANSADPALLLAGAVQSQKLAVRAISRLQSLPGGDIGTLCDTVVEDVQKLTGYDRVMVYKFHDDSHGEVVSEIRRSDLEPYLGLHYPATDIPQAARFLFKQNRVRMICDCNAQPVKVLQCEELKQPLCLVNSTLRSPHGCHTKYMANMGSIASLVMAVVINSSESMKLWGLVVCHHTSPRYVPFPLRYACEFLMQAFSLQLYMELQLASQLAEKKILQTQTLLCDMLLRDAPFGIVTQTPSIMDLVRCDGAALYYNGKCWLLGVTPTETQVKDIAEWLLHNHGDSTGLSTDCLSDAGYPGAPLLGDAVSGMATARITSKDFLFWFRSHTAKEVKWGGAKHHPEDKDDGGRMHPRSSFIAFLEVVKSRSLPWEDSEINAIHSLQLIMRDSLQGIGENYMKSVSSPQQNDSDGVRFYELSSMALELVRLVETATVPIFGVDSSGLINGWNAKIAELTGLQANVAIGKYLIDDVTHEDSHETFKALMCRALQGEEDRNVEVKLLKFGNHPTKEVVYLVVNACTSRDYKNDIIGVCFVGQDITPEKAVMDKFVRLQGDYEAIIQSLNPLIPPIFASDENACCSEWNAAMERLTGLVKCEVIGKRLPGEIFGGLCRLKGQDALTKFMILLYQGISGHDTEKLSFGFFDRKGNFIDVFITANKRTDERGNIIGCFCFLQTMAVDHPQISARDIEDDRECLSTLKEFAYIQQQMKNPLNGIRFTHKLLEGTVTSDHQKQFLETSEACEKQILSIIENMDSGGIVDGNRVELKTEEFVIGNVIDAVVSQVMIPLKEKNLQLLHDIPDQIKSLPIYGDQIKLQLVLSDFLLSIVRHAPSPDGWVEIRVSPGLKLIQDGNVFIHIQFRMTHPGQGLPSALIEDMVRGGTRWTTQEGVVLHLSQKLVRMMNGHVHYVREQQKCYFLIDLDFKTQKPRSRESSMDTKAD

SEQ ID NO: 67461 - protein, 379 aa, Boechera parishii
MSTTGQIVRCKAAVAWEAGKPLVMEEVEVAPPQKHEVRIKILFTSLCHTDVYFWEAKGQTPLFPRIFGHEAGGIVESVGEGVTDLQPGDHVLPVFTGECGDCRHCHSEESNMCDLLRINTERGVMIHDGESRFSINGKPIHHFVGTSTFSEYTVVHSGQVAKINPDAPLDKVCIVSCGLSTGLGATLNVAKPKKGQSVAIFGLGAVGLAAAEGARIAGASRVIGVDLNPKRFDEAKKFGVTEFVNPKDHDKPVQQVIAEMTDGGVDRSVECTGSVQAMIQAFECVHDGWGVAVLVGVPSKDDAFKSHPMNFLNERTLKGTFFGNYKPKTDIPGIVEMYMNKELELEKFITHTVPFSEINKAFDYMLKGESIRCIITMGA

SEQ ID NO: 67462 - protein, 379 aa, Fourraea alpina
MITTGQIIRCKAAVAWEAGKPLVMEEVEVAPPQKHEVRIKILFTSLCHTDVYFWEAKGQTPLFPRIFSHEAGGIVESVGEGVTDLQPGDHVLPIFTGECGDCRHCHSEESNMCDLLRINTERGGMIHDGESRFSINGKPIYHFLGTSTFSEYTVVHSGQVAKINPDAPLDKVCIVSCGLSTGLGATLNVAKPKKGQSVAILGLGAVGLAAAEGARIAGAARIIGVDLNPKRFEEAKKFGVTEFVNPREHDKPVQEVIAEMTDGGVDRSLECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 67463 - protein, 379 aa, Arabidopsis lyrata subsp. petraea
MITTGQIIRCKAAVAWEAGKPLVMEEVEVAPPQKHKVRIKILFTSLCHTDVYFWEAKGQTPLFPRIFGHEAGGIVESVGEGLTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVVKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTLPFSEINKAFDYMLKGESIRCIITMGA

SEQ ID NO: 67464 - protein, 502 aa, Coprinopsis cinerea okayama7#130
MPKTYTHKFDTQAYKGSSTISTGLFINGEWVDPVQGDEIDIVNPATGEVITKVAIGTKADVDKAVAAARKVCAYKTTWGLKASGSERARLLNKLADLIEKNLEELAALESLDVGKVYANAKVMDIGGAVIVFRYYAGWADKIQGTTVESGDTKLNYVRREPYGVCGQIIPWNFPMVAPALATGNTVVLKPSEVTPLTALRFADLVVEAGFPPGVVNIVNGYGHTVGAAIAEHPNIDKVAFTGSTLTGRRILKAAADSNLKPVTLELGGKSPTIIFDDADFEQALKWTTAGIYSNMGQVCTAGSRIFVQEGIYDKFVESFAAVAKGFGQATGDPFAEGTKHGPQVSQTQFDRVLSYIESGKKEGATAIVGGDKHGDKGYFIQPTIFTGVTKDMKIAREEIFGPVASVFKFKTEEGELSFVIELANDTVYGLAAYVFSENISRGIRVAHALEAGSVAVNSTVPFDVGMPFGGYKQSGIGRELGQYAIDTYTQNKAVHVNIGLRI

SEQ ID NO: 67465 - protein, 379 aa, Arabidopsis lyrata subsp. petraea
MITTGQIIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFFGNYKPKTDIPGVIEKYMNKELELEKFITHTLPFSEINKAFDYMLKGESIRCIITLGA

SEQ ID NO: 67466 - protein, 156 aa, Myxococcus xanthus DK 1622
MDRTGGAWAVIHADSLPKVAAFLKNDPELEFKLFGSIDAVDRLHLAENDPRFEVVYFLYSLKRHEHVRLKVRVSEANPVVPTLVPLFRGANWWERLTFDFYGIRFDGHPDLRRILLYDEFEGHPLRKDYALRDRQPLIPERPIKDIFRGPGTSGLS

SEQ ID NO: 67467 - protein, 215 aa, Kluyveromyces lactis NRRL Y-1140
MSASFVTVRSKAISLESQTDSLLTKYSSFAQTTSSEPSGQETQLQEKLEKILNQRQETVESLQRIADSESNISTSKLSQLQRHRETLQDNWQTFRDIRSSIQQERNRLNLLFSVKKDLQNSASDNQNEYIQDEARRVENSHTVVDSLIDQAYETREQFMSQRVFLQRSSDRILQTLQHIPLINNVISKINTRRKKNAVILASLISICILVLFFTA

SEQ ID NO: 67468 - protein, 458 aa, Triticum aestivum
MAARAQNNVAAAQQQNRALGGGGGGVPAMGKQQKAAMAGRPDPKNTRRALGDIGNFEANNRRAPLGDIANVVNARAAEGKPQPHEPVNRPVTRNFGAQLLKNAQEKAKNPAARPAVRRAHHVKPPPPPPEHVIEISSDSDVTKSEAGSVSSVRKYSRKKVVTTLSHVLSARSKFAAGITEEPAIQDIDKLDGDNQLAVVDYIEDIYKFYKVAENECLASDYMDSQVEINAKMRGILIDWILEVHQKFDLMPESLYLTVYIIDMYLSLQSVLRRELQLVGVSALLIACKYEEIWAPEVNDFILISDSAYTREQILKMEKAILNRLEWNLTVPTPYVFLVRFAKAACSSDHKNDKEMENTVFFFAELALLQYGLVQSKPSMVAAAAVYAARLTLKKTPLWTDTLKHHTGFTEAQLMDAAKILVASHSTAPDSKLKVVYKKYSSEKLGGVALRPPATDLCK

SEQ ID NO: 67469 - protein, 388 aa, Bacillus cereus G9241
MIKNPKVLILTAHYGNGHVQVAKTLEQTFRQKGIKDVIVCDLFGESHPVITDITKYLYLKSYTIGKELYRLFYYGVEKIYDKKIASWYANFGRKRLKLLLQAEKPDIVINTFPIIAVPELKKQTGISIPVYNVLTDFCVHKIWIHREVDRYFVATDHVKKVMVDIGVPAEQIVETGIPIRSSFELKINPDIIYNKYQLCKNKKILLIVAGAHGVLGSVKELCQSFMSVPDLQVVVVCGKNEALKQDLLGLQEKNPDALKVFGYVENIDELFRVTSCMITKPGGITLSEAAALQVPVILYKPVPGQENENAMYFERKGAAVVIRDDSEVFAKTEALLQDDMKLLQMKEAMKSIYRPEPADHIVDTILAENHVEPNHIPIKSPALAQSFT

SEQ ID NO: 67470 - protein, 332 aa, Oryza sativa (japonica cultivar-group)
MSSRMAGSAILRHVGGVRLFTASATSPAAAAAAAARPFLAGGEAVPGVWGLRLMSTSSVASTEAAAKAEAKKADAEKEVVVNSYWGIEQSKKLVREDGTEWKWSCFRPWETYTADTSIDLTKHHVPKTLLDKIAYWTVKSLRFPTDIFFQRRYGCRAMMLETVAAVPGMVGGMLLHLRSLRRFEQSGGWIRTLLEEAENERMHLMTFMEVANPKWYERALVITVQGVFFNAYFLGYLLSPKFAHRVVGYLEEEAIHSYTEFLKDLEAGKIDNVPAPAIAIDYWRLPANATLKDVVTVVRADEAHHRDVNHFASDIHYQGMELKQTPAPIGYH

SEQ ID NO: 67471 - protein, 281 aa, Oryza sativa (japonica cultivar-group)
MAASTPAASRERRWSLAGKTALVTGGTKGIGRAIVEELAGFGVRVHTCSRHDADLQDCLRRWNAADGGGLGGGAAAPVTASVCDVSVRGDREALVAAARAALGGRLDILVNNVGQTLFGAAAACAAEDYARIMATNLESCFHLAQLAHPLLLGAGGAAASVVNISSVAGFIAYPALSVYSATKGAMNQLTRSLAAEWARDGIRVNCVAPGGVRTDIAGSSGVALEPGAARAMEEREAARVVMGRIGEPEEVASLVAFLCMPAAPYITGQVICVDGGRTITA

SEQ ID NO: 67472 - protein, 344 aa, Xanthobacter autotrophicus Py2
MKGLVYRGPGKKALEEVPHPRIEQPTDAVVKILRTTICGSDLHILKGDVPTVKPGTVLGHEGVGVIEEVGQAVSAFRKGDHVLISCISSCGRCEYCKRGMYSHCSVAGWMLGHTIHGTQAEYVRIPFADTSLHRIPDGMDEEALVMLSDILPTGFECGVLNGKVQPGSTVAIVGAGPVGLAALLTAQFYSPAEIIMIDLDDNRLEVALTFGATKTVNSGRENAVERVMALTGGIGVDTAIEAVGIPATFVLCQDIVAPGGTIANVGVHGTKADLHLERLWAHNITLTTRLVDTVTTPMLLKTVQSKKLDPQRLITHRFALADILEAYETFEKAAQTRALKVIIG

SEQ ID NO: 67473 - protein, 544 aa, Ralstonia eutropha JMP134
MPTDFDSGLGRNAANFVPITPIDFLVRAAEVYGDRPAIVHGPVRQNWRDTYVRARRLASALARAGVGKGDTVAALLPNTPAMVEAHFGVPMAGAVLNALNIRLDAANLVFMLRHGEARVLLADTEFADLARQMALEIPGLKVIAVEDALGPQAERFGDTDYESFLASGDPEYAWKMPDDEWDAIALNYTSGTTGDPKGVVYHHRGAAMNAISNILEWDLPKHPVYLWTLPLFHCNGWCFPWTIAARAGVNVCLRKFEPRLVFDLMRDEGVTHYCAAPIVHTALVNAPPSWREGLRGPVRGMVAGAPPPAAVLAQMEAMGFELTHVYGLTEVYGPAAVCAEQDGWDSLSQEERAVKKARQGVRYHLQSGVAVLDPDSMQPVPADGETIGEIMFRGNICMKGYLKNEKATREAFAGGWFHTGDLGVCMADGYIKIKDRSKDIIISGGENISSVEVEDALYRHPAVLAAAVVAQPDAKWGETPCAFVELKDGASATAEELMAHCRTLLAGFKVPKAVYFGPLPKTSTGKIQKFELRRKVKSDSAIDV

SEQ ID NO: 67474 - protein, 318 aa, Synechococcus sp. RS9917
MGPEHQPAFAIDAVPGLADLLTALEVGDAGRWLERWQQRGGAAFQHQAWGHPVAEPWVWAIALPLLTALERHCRAGERRLVGLSGLPGCGKSTLARWLASAAADLDLPVAVVSIDDFYWPGEQLEQAMAGNPWGVPRALPGSHDLELLNASLERWRRSGELRMPQFEKSLRGGRGDRSGWQQQTAQVVLLEGWFLGACPGHASTESFEAISALALSEAERQGRAQALNQLVHYQPIWDRLDDLWHLKAPSPSASRRWKEEQERAMEQRTGIRLPAEELEGFVRMIETAIPETVLQNPRDVAVVVHLTETRRVREVQLR

SEQ ID NO: 67475 - protein, 322 aa, Brassica napus
MFFDGYHYPGTTFEHSYRCYPASFIDKPQIESGDKIIMPPSALDRLASLHIDYPMLFELRNAGSERVSHCGVLEFIAEEGMIYMPYWMMQNLLLQEGDIVRVRNVTLPKGTYVKLQPHTTDFLDISNPKAILETALRNYSCLTTGDSIMVPYNNKKYFIDIVETKPANGISIIETDCEVDFAPPLDYKEPERPKAPAAAAKALAKAEEVVAEPEPKFNPFTGSGRRLDGRPLSYEPPSSSSSSSKDKQPAVANGNGQSSVASGSERAARQAQGKLVFGANANRAPKEAPKVGAGKETKKEEEEKKEESKFQAFTGKKYSLRG

SEQ ID NO: 67476 - protein, 471 aa, Ralstonia solanacearum GMI1000
MSQSIADVMKLVKENDVKFVDFRFTDTKGKEQHVSVPVSHFGEDKFESGHAFDGSSIAGWKGIEASDMLLMPDANTAHIDPFYEEPTLVMTCDVIEPSDGKGYDRDPRSIAKRAEAYLKSTGLGDTAYFGPEPEFFIFDGVTWNVDMQGSFVKIHSEEAPWSSGKEFEHGNSGHRPGKKGGYFPVAPIDTFQDIRSEMCLILESLGIPVEVHHHEVAGQGQNEIGTKFSTLVQRADWTQLQKYVIQNVAHTYGKTATFMPKPVVGDNGSGMHVHQSVWKDGQNLFAGNGYAGLSEFALYYIGGIIKHARALNAITNPGTNSYKRLVPGFEAPVKLAYSARNRSASIRIPYVANPKGRRIETRFPDPLCNPYLGFAALLMAGLDGVQNKIHPGEAADKNLYDLPPEEDAKIPTVCSSLDQALEYLDKDREFLTRGGVFTNSMIDAYIELKMEEVTRFRMTTHPVEFEMYYSL

SEQ ID NO: 67477 - protein, 379 aa, Arabis procurrens
MITTGQIIRCKAAVAWEAGKPLVMEEVEVAPPQKHEVRIKILFTSLCHTDVYFWEAKGQTPLFPRIFGHEAGGIVESIGEGVTDLAPGDHVLPIFTGECGDWPHCHSEESNMCDLLRINTERGGMIHDGESRFSINGKPIHHFVGTSTFSEYTVIHSGQVAKINPDAPLDKVCIVSCGLSTGLEAPLNVANPKKGQSVAIFGLGAVGLAAVEGARIAGASRIIGVDLNSKRFDEAKKFGVTEFVNPKDHDKLVQQVIAEMTNGGVDRSVECTGSVQAMIQAFECVHDGWGVAVLVGVPSKDDAFKTHPMNFLNERTLKGTFFGNYKPKTDIPGLVEKYMNKELEIEKFITHTVPFSEINKAFDYMMKGEGIRCIITMGA

SEQ ID NO: 67478 - protein, 585 aa, Gossypium hirsutum
METHRRSSTNSIRSHKPARPIALEDDSTKASDALPLPLYLTNAVFFTLFFSAVYFLLCRWREKIRSSTPLHVVTFSEIVAILASVASFIYLLGFFGIDFVQSLVLRPSADVWATEDDEVESEVLLRNEDARHVPCGQALDRSIRSLQPPEPIVTAEKVFDEMPVTVMTEEDEEIIRSVVCGMTPSYSLESKLDDCKRAAAIRREALQRITGKSLSGLPLDGFDYESILGQCCEMPVGYEQIPVGIAGPLLLNGREYSVPMATTEGCLVASTNRGCKAIHLSGGATSVLLRDGMTRAPVVRFGTAKRAADLKLYLEDPENFETLACVFNRSSRFARLQSIKCAIAGKNLYLRFSCFTGDAMGMNMVSKGVQNVLDFLQTDFPDMDVIGISGNFCSDKKPAAVNWIEGRGKSVVCEAIINGDVVTKVLKTSVESLVELNMLKNLTGSAMAGALGGFNAHASNIVTAVYIATGQDPAQNVESSHCITMMEAVNGGKDLHVSVTMPSIEVGTVGGGTQLASQSACLNLLGVKGASKESPGANSILLATIVAGAVLAGELSLMSALAAGQLVKSHMKYNRSSKDVSKVSS

SEQ ID NO: 67479 - protein, 379 aa, Arabis procurrens
MITTGQIIRCKAAVAWEAGKPLVMEEVEVAPPQKHEVRIKILFTSLCHTDVYFWEAKGQTPLFPRIFGHEAGGVVESVGESVTDLAPGDHVLPIFTGECGDCPHCHSEESNMCDLLRINTERGVMIHDGESRFSIDGKPIYHFVGTSTFSEYTVIHSGQVAKINPDAPLDKVCIVSCGLSTGLGATLNVAKPKKGQSVAIFGLGAAGLAAAEGARIAGASRIIGVDLNSKRFDEAKKFGVTEFVNPRDHDKPVQQVIAEMTDGGVDRSVECTGSVQAMIQAFECVHDGWGVAVLVGVPSKDDAFKTDPMNFLNERTLKGTFFGNYKPKTDIPGLVEKYMNKELEIEKFITHTVPFSEINKAFDYMLKGKGIRCIITMGA

SEQ ID NO: 67480 - protein, 628 aa, Gossypium hirsutum
MEASRRSAVKPVIVLKPSKRFPLVEDTPGKASDALPLPLYLTNAVFFTLFFTVVYFLLSRWREKIRASIPLHAVTFPEIVAIFAFVASLIYLLGFFGIDFVQSLIIRPSGDVWSGEDYEEENEVLLHEEDARTVPCGQALDCSVPSLPHMARNVTAQRLFDEKPVRVATEEDARKVSCGQAVDCSLHSLPPRPPIVTSQKLFHEKTVIVTTEEDEEIIKSVVAGTLPSYSLESKLGDCKRAAAIRREALQRLTGRSLSGLPLDGFDYESILGQCCEMPVGYVQIPVGIAGPLLLNGREYSVPMATTEGCLVASTNRGCKAIHLSGGATSILLKDGMTRAPVVRFSTAKRAAELKFYLEDPENFDTLAVVFNRSSRFGRLQSIKCAIAGKNLYLRFTCSTGDAMGMNMVSKGVQNVLDFLQTDFPDMDVIGISGNFCSDKKPAAVNWIEGRGKSVVCEAIIEGDVVRKVLKTSVESLVELNMLKNLTGSAMAGALGGFNAHASNIVTAIYIATGQDPAQNVESSHCITMMEAVNDGKDLHISVTMPSIEVGTVGGGTQLASQSACLNLLGVKGASKDVAGANSRMLATIVTGAVLAGELSLMSALAAGQLVKSHMKYNRSSKDMSNLSS

SEQ ID NO: 67481 - protein, 379 aa, Arabidopsis thaliana
MSTTGQIIRCKAAVAWEAGKPLVIEEVEVAPPQKHEVRIKILFTSLCHTDVYFWEAKGQTPLFPRIFGHEAGGIVESVGEGVTDLQPGDHVLPIFTGECGDCRHCKSEESNMCDLLRINTERGGMIHDGESRFSINGKPIYHFLGTSTFSEYTVVHSGQVAKINPDAPLDKVCIVSCGLSTGLGATLNVAKPKKGQSVAIFGLGAVGLGAAEGARIAGASRIIGVDFNSKRFDQAKEFGVTECVNPKDHDKPIQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 67482 - protein, 379 aa, Pseudoturritis turrita
MITTGQIIRCKAAVAWEAGKPLVMEVVEVAPPQKHEVRIKILFTSLCHTDVYFWEAKGQTPLFPRIFGHEAGGIVESVGEGVTDLQPGDHVLPIFTGECGDCRHCHSEESNMCDLLRINTERGVMIHGGESRFSINGKPIYHFLGTSTFSEYTVVHSGQVAKINPEAPLDKVCIVSCGLSTGLGATLNVAKPKKGHSVAIFGLGAVGLAAAEGARISGASRIIGVDLNPKRFEEAKKFGVTEFVNPRDHDKPVQQVIAEMTDGGVDRSVECTGSVQAMIQAFECVHDGWGVAVLVGVPSKDDAFKTHPMNFLNERTLKGTFFGNYKPKTDIPGVVEKYMNKELEIEKFITHTVPFSEINKAFDYMLKGEGIRCIITMGA

SEQ ID NO: 67483 - protein, 379 aa, Barbarea vulgaris
MITTGQIIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPEAPLDKVCIVSCGLSTGLGATLTVAKPKKGQSVAVFGLGAVGLGAAEGAKMAGASRIIGVDLNPKRFEEAKKFGVTEFVNPREHDKPVQQVIADMTNGGVDRSVECTGSVQAMIQAFECVHDGWGVAVLVGVPSKDDAFKTHPMNFLNERTLKGTFFGNYKPKTDIPGVVEMYMNKELELEKFITHTVPFSEINKAFDYMLKGESIRCIITMGA

SEQ ID NO: 67484 - protein, 266 aa, Oryza sativa (japonica cultivar-group)
MTAANLDSEMGLIGEMMVQYPYVTIDVEFAGVVHHPPYTGSRPTPDEIYAALKSNVDEVPAVQIGITLSDAEGNLPTRSSSSPEQEIAWEVVFSDFDAGRDPHVVDSVEFLKNQGIDFDLARQIGVTSTAFGEKLLAILPPPSRRGELTWSAFGGAYDMGYLLKMLTGGQPLPETRQQFMQLVKSRLGGGRIFDSKYLVEHDRQDLRNAGLRHTADVLGVRQQEGVKMLAGHKSVVAAAIFATIRSQGVSPPAWSYRWNFIVHIYL

SEQ ID NO: 67485 - protein, 269 aa, Triticum monococcum
MDVADIASPSGQQEQGHRTVSSEPPKRPAGRTKFHETRHPLYRGVRRRGRVGQWVCEVRVPGIKGSRLWLGTFNTAEMAARAHDAAVLALSGRAACLNFADSAWRMLPVLAAGSFGFGSASEIKAAVAVAVVAFQRKQIVLPVAVAVVALQQKQVPIAVAVVALQQKQVPVAVAVVALQQLPVPVAVAVVALQQQQIILPVACLAPEFYMSSGDLLELDEEQWFGGMEAGSYYASLAQGMLVAPPDERARPESGEQSGVQTPLWSCLFD

SEQ ID NO: 67486 - protein, 345 aa, Coprinopsis cinerea okayama7#130
MGLKSTDTPPNRLNPKGYKWAEHISTRLNTGLRPLTPILLIILFTSLFNQSPLGTHFYSWLNHHYTPFQINAYWSFGVTSIVYWVGGLVFLVGDLFQPRFLHQYKIQPAQHVSWGDYKKIMWVVARNQVGICFDYYLLVALPLSILNAYISPLPTGFPLPGTLETIWTYIFCLACEEIGFFYVHRTLHAPIFYKRFHKMHHEFVAPVAFASTYCTLTEHLFSNILPIILGISLLKAHWSLMIMFFSSLELATLSSHSGYNLPFNNNALQHDWHHFFYTENYGPTGLLDSLHGTNRVFKAWMGELRRRDGGGRVKEGEEVLREGRRELATGEVRGVTPPEMVDKED

SEQ ID NO: 67487 - protein, 229 aa, Glycine max
  misc_feature (138)..(138): Xaa can be any naturally occurring amino acid
  unsure (1)..(229): unsure at all Xaa locations
SSRIGSSTRRQKGDNSSQLRSAPPRKKREMATETKVQELGGITDVHGAANSVEINNLARFAVEEQNKRENSVLEFVRVISAKQQVVAGVNYYITLEAKDGLIKNEYEAKVWVREWLNSKELLEFKPVNVSSTPIGGIXRVTANSLEIDILARFAVDQHNKKENANLEFVGVIRAKQQVVEGFIYYITLEAKDGETKNVYETKVWVRSWLNSKEVLEFKPISINPLSVSV

SEQ ID NO: 67488 - protein, 572 aa, Arabidopsis thaliana
MVGGGGGSSGRGGGSGSGSSKQQRGFSMNPKDYKLMEEIGHGASAVVYRAIYLPTNEVVAIKCLDLDRCNSNLDDIRRESQTMSLIDHPNVIKSFCSFSVDHSLWVVMPFMAQGSCLHLMKTAYSDGFEESAICCVLKETLKALDYLHRQGHIHRDVKAGNILLDDNGEIKLGDFGVSACLFDNGDRQRARNTFVGTPCWMAPEVLQPGNGYNSKADIWSFGITALELAHGHAPFSKYPPMKVLLMTIQNAPPGLDYDRDKKFSKSFKEMVAMCLVKDQTKRPTAEKLLKHSCFKHTKPPEQTVKILFSDLPPLWTRVKSLQDKDAQQLALKRMATADEEAISQLIDDDDLEESKEDEEILCAQFNKVNDREQVFDSLQLYENMNGKEKVSNTEVEEPTCKEKFTFVTTTSSLERMSPNSEHDIPEAKVKPLRRQSQSGPLTSRTVLSHSASEKSHIFERSESEPQTAPTVRRAPSFSGPLNLSTRASSNSLSAPIKYSGGFRDSLDDKSKANLVQKGRFSVTSGNVDLAKPTAQPQTIKEHSSHPTSSSPIMPQLQHLFQQNSIQQVRNIH

SEQ ID NO: 67489 - protein, 483 aa, Halobacterium sp. NRC-1
MREAIPAVIETVLGAADGDIDAVAFSRGPGLGPCLRIVGSAARALAQALDVPLVGVNHMVAHLEIGRHQSGFQQPVCLNASGANAHVLAYRNGRYRVLGETMDTGVGNAIDKFTRHVGWQHPGGPKVETHARDGEYTALPYVVKGMDFSFSGIMSAAKDAVDDGVPVADVCRGLEETMFAMLTEVAERALALTGRDELVLGGGVGQNDRLRGMLEAMCAARGASFHAPEPRFLRDNAGMIAVLGAKMAAAGATIPVADSAINSQFRPDEVSVTWRDPESPARDPGADAVRQGAEATVTFADDAVIKERAPKAYRHDRLDDRLRRDRTVLEARLTSDARRQGVPTPLVRDVDVPAATITLQHVGDADLRDALSPARVRAVGRHLATIHDGGFVHGDPTTRNVRVGAERTFLIDFGLGYYTDAVEDYAMDCHVFEQSLVGTAADADALVAAFEDAYEEAAASGRVLDQLRAVEGRGRYQDDPETA

SEQ ID NO: 67490 - protein, 167 aa, Corynebacterium diphtheriae NCTC 13129
MSTAVKVVVMGVSGSGKTTVGTLLAERLGVEYRDGDDLHSQANIEKMASSIPLNDDDRWPWLAQVGEWLAAQLAGGVIGCSALKRSYRDVLRRECPEVVFVHVYGSREVLLERMNHREGHFMPASLLDSQFATLQPLENDEVGHVFDVTDSPAQIADAAARWLSERS

SEQ ID NO: 67491 - protein, 96 aa, Glycine max
  misc_feature (17)..(17): Xaa can be any naturally occurring amino acid
  unsure (1)..(96): unsure at all Xaa locations
DSSMISYPADTTDNPAXAEMTAPFTDLNALHVLPTIKTNNELTSIASNPGKLLCMQVCTPLVNKKFETLSYLPDLDDATFEDEPEYLLMNGWIPCL

SEQ ID NO: 67492 - protein, 288 aa, Prochlorococcus marinus str. MIT 9303
MIDGHHSPLLRKQSPYPHWQYLHPESGDRLRIVPERGGLVTDWCCNGHELLYFDQERFADPEKSIRGGIPVLFPICGNLPGDLLPLPSGEFILKQHGFARDQPWELQLLEDHSGVKLSLADSEETRAVYPFAFLLEMVVRPIRNALEIEVNVHNRSQTAMPFSFGLHPYFKVTDLSQVRLEGLPNSCLNHLQMAEAETAIQLAALTEGVDFLTRPEGPVTLVDEASWRSLQLQHENPMDLTVVWTDPPRQMLCLEPWTGPREALISGDRKLEIEAGGKQRLCCGYFSS

SEQ ID NO: 67493 - protein, 447 aa, Chlorobium limicola
MADPNHRNSLTITDNRTGKSYELPIENGTVRTMDLRQIKASEDDFGLLGYDPAFLNTCSCKSQITFIDGEKGILRYRGYPIEQLAEKSSFLETAYLLIKGELPDKERLAVWTYNIRHHTMTHANLTKFMDGFRYDAHPMGILVGTVGALSTFYPDAKQVSEEESRKLQVRRLIGKIPTLAAMSFRHSLGFPYVLPDNDLSYAGNFLSMMFRMTEQKYEPNPVLEKALDVLFILHADHEQNCSTNAVRSVSSSMVDPYSAIAAGCAALYGPLHGGANEAVIRMLEGIGSVDNIPAFIKSVKSGEGRLMGFGHRVYKNYDPRARIIKKIAFEVFEETGRNPLLDIAIELERIALEDDYFVGRKLYPNVDFYSGLIYQAMGFPTDMFPVLFAIGRTPGWLAQWIEHVKDPEQRIARPRQIFLGAPCRDYVPLDERPSRGDDEEKFGICRL

SEQ ID NO: 67494 - protein, 425 aa, Rhodospirillum rubrum ATCC 11170
MDYFSYRNGQLHAEDVALAAIAEAVGTPFYVYSAATLERHFRVFSDAFAGQPITLCFATKTNGNKAVLALLAGLGAGADVVSQGEMEHALAAGVPAGRIVFSGVAKTKAEMAAALEAGIFQINVESEPELEALSEVAQALGKTAPVALRINPDVAAATHDKIATGRKENKFGIDWTVAPAIFAKAAGLPGIAVKGVAVHIGSQILDLDPFRRAFERLRELVLALRADGIALERVDLGGGLGIPYHRDDPASPPPAEYAALARRIFGDLGVHLVAEPGRLIAGNAGMLVSRVVYRKQGETRTFLILDAGFNDLIRPAMYDAFHDILPVTAAAENAVLTPVDVVGPICESGDIFARQRPLPPIAAGDLVAFATAGAYGASMSSTYNGRPLVPEVMVSGDRFAVVRRRPSVAEMTALESVPPWLAKQA

SEQ ID NO: 67495 - protein, 452 aa, Pseudomonas putida KT2440
MNAPFDQLSTWLKEHRITEVECVISDLTGIARGKIAPTAKFLHERGMRLPESVLLQTVTGDYVDDDIYYNLLDAADIDMVCRPDPTAVYQIPWAIEPTAIVIHDTFDKQGNPIELSPRNVLKKVLKLYADKGWQPIVAPEMEFYLTKRCEDPDLPLQVPLGRSGRAESGRQSFSIDAANEFDPLFEDVYDWCEIQGLDLDTLIHEDGPAQMEINFRHGDALDLADQITVFKRTMREAALKHNVAATFMAKPITDEPGSAMHLHQSVVDIATGKPIFANEDGSMSQLFLHHIGGLQKYIPKLLPMFAPNVNSFRRFLPDTSAPVNVEWGEENRTAGLRVPTSSPEAMRVENRLPGADANPYLAIAASLLCGYLGMVEQIDPSAPVQGRAYERRNLRLPITIEDALQHMEDCETVQQYLGKQFVQGYVAVKRAEHENYKRVISSWEREFLMLSV

SEQ ID NO: 67496 - protein, 578 aa, Magnaporthe grisea 70-15
MDGNPQAFTIYTFFQLLINYLSGERALIIMTHGREPVEHLWPMNYVMSRVDISDPYSFLAIKRGILQYAWLKPTLALAAVIMKATGTYKEGYLGLDSGYFWSGLVYNVSMTICLYCLALFWVCMHDDLKPFRPVPKFLCIKLIIFASYWQGFFLSILVWLGAITDKVEGYSPDNLAAAIQDFLICIEMPIFAVAHWYAFSWHDFANDAIEEARMPVKFALRDSFGIRDLIEDSKETFKGDKYGYRGFDSRDKIMAHESSKSRLARVKAGMRYERGGKGKYWIPSPGEITSDVNPYTPLLGGKNGNGGGQSNSPGGPSRTSSSSNVHEDSGIIGDDKLDPEEELLYDKARKLEYGDWNYPVIIANVPRRPWETSRPSPQSGRSRTSLPAPSSFSANGRGLKERDQRQDDEGAVVAKKSKGKGKAKPRAAAQSGRSTSPQETPRPAVEAQAKPDLSEIDFDVSKMSSTDENNTSSVAPQSESESNHWEDESEPAVISPKYDIDEEDMRNLFERLNGYHEEPEGKTTRPIYWRPHFPENLLRKGTSQGSPLIARSTVEPVAQFVALQCTLWVQAKITLDQV

SEQ ID NO: 67497 - protein, 243 aa, Zea mays
  misc_feature (103)..(103): Xaa can be any naturally occurring amino acid
  unsure (1)..(243): unsure at all Xaa locations
SGLSGSSAIVCAALSCLLDFYNVRHLIKVEMRPNLILNAEKELGIVAGLQDRVAQVYGGLVYMDFSQGHMDKLGHGIYMPLDVNLLPPLYLIYADNPSDSGKXVHSTVRQRWLSGDDFITSRMKEVAQLALDGHKALLQKDYTELARFMNKNFDLRREMFGDDVLGALNIKMVDVATQRGRSVQVHWQRRRSGGAVPRWGFAGGASPQGMPGGRLCSTASESCPLGADGRGAVKFIISFLVER

SEQ ID NO: 67498 - protein, 418 aa, Ralstonia solanacearum GMI1000
MAIVDVKVPQFSESVEEGTLISWKKKPGEAVTVDEVLVEIETDKVVLEVPAPSAGVLAEVLVADGATVTSEQLLAKIDTEGKAGAAAPAAAAPAPAAAAPAPVAAAPAAAAATGGVAMPSAAKLMAEANLSAGQVAGTGRDGRITKGDVLGAVAGGAKPAPAAAPQAARPALQQVAAPVDFAVLGDRPEERVPMSRLRARIAERLVQSQSTNAILTTFNEVNMKPVMDLRAKFKDQFEKTHGVKLGFMSFFVKAAVHALKKYPVINASVDGNDIVYHGYFDIGIAVGSPRGLVVPILRNADQMSLADIEKKIAEFGQKARDGKLTLDDLTGGTFSISNGGTFGSMLSTPIINPPQSAILGVHATKDRAVVENGQVVVRPMNYLAMSYDHRIIDGREAVLGLVAMKEALEDPARLLLDL

SEQ ID NO: 67499 - protein, 231 aa, Oryza sativa (japonica cultivar-group)
MAEVGVIPVLPEPGPTTISAPRHTAADARGAPETESYNRAVQRLKDGSGKGSATEADARCGCSRATSRWCRSYANFSADSAESYGNMMKNKVLGTDGSDGDMPAAQMPAFAYLHLNHDYGDDDKMFFCDDDQRLVMRTDTYIVPSLFLVTTFQDELDALFPERGAVFHYLGRYLFPQANHTAVLQRVPRAGVAAAGRRPGARLRPPARRSRRTSSSSSSSRARGRRSCYRR

SEQ ID NO: 67500 - protein, 501 aa, Oryza sativa (japonica cultivar-group)
METRELWVLAAALAVSLLYYLAALMRYAGGGCSRSSRPPLPPGPTPLPLIGNLLSLRGVLHHRLASLARVHGPVMALRLGLTTAVVVSSRDAAAEAFTKHDRRLAARVVPDSNRAHGFSDRSIIWLPSSDPRWKALRGIQATHLFSPRGLAAVRSVRESKVRDIVAYFRSRAGEEVVFGEAIYSGVLNLVSSSFFSVNMAGVGSEEAHGLRELVEDLVEAIAKPNVSDLFPFLRQLDLQGLRRRTEERMARAFGILDGIIDRRLANRTHGDRHGDFLDALLDLVSEGKMARDHVTIMLFEVFGAGSDTMSVSLEWAMAELLRNPRAMRKARAELEDAAAVVEESDAARLPYLQAVVKEAMRLHPVGPILLPHRAVEDGVEIGGYAVPRGAMVIFNAWAIMRDPAAWERPDEFVPERFMETTTAIDFRGKEYEYLPFGSGRRLCPGLPLAERVVPFVLASLLRAFEWRLPDGVSAEDLDVSERFNTANVLAVPLKVVPVIVN

SEQ ID NO: 67501 - protein, 274 aa, Hyoscyamus niger
MAGESEVYINGNNGGIRWSLKGTTALVTGGSKGIGYAVVEELAGLGARVYTCSRNEKELQQCLDIWRNEGLQVEGSVCDLLLRSERDKLMQTVADLFNGKLNILVNNAGVVIHKEAKDFTKEDYDIVLGTNFEAAYHLCQLAYPFLKASQNGNVIFLSSIAGFSALPSVSLYSASKAAINQITKNLACEWAKDNIRVNSVAPGVILTPLIETAIKKNPHQKEEIDNFIVKTPMGRAGKPNEVSALIAFLCFPAASYITGQIIWADGGFTANGGF

SEQ ID NO: 67502 - protein, 474 aa, Oryza sativa
MKNMKFLTDKRPPSLVVAEALQLLVVIVVAAWDREPHLSLPCSAPPDPPLSSSLPFLLPWKRSQGASRRRPSPRLHNHRPAVGSAQVGSAPDGSAVSLLHLLLRRLRRFHDPRRPLALPPSSPLARARRWDPSGSKDCKIVRGIIDAVAKIIGTSELQISLCKEMVEWTRAEKRTFLRQRVEARLAALLLENQEYTDALTLLTDLIKEVRRLDDKLLLVDIDLLESKLHFSLRNLPKAKASLTAARTAANAIYVPPAQQGTIDIQSGILHAEEKDYKTAYSYFFEAFEAFSALEDPKAIFSLKYMLLCKIMVNQADDVAGIISSKAGLKYLGPDVDAMKAVADAYSKRSLKYFETALRDYKSQLEEDPIVHRHLSSLYDALLEQNLCRLIEPYARVEIAHIAEMIELPVDHVEKKLSQMILDKKFAGTLDQGAGCLIIFEDPKTEAIFPATLETISNVGKVVDSLYMRSAKIMA

SEQ ID NO: 67503 - protein, 500 aa, Oryza sativa (japonica cultivar-group)
MENSQMWLLWGALSVALFFYFSTLRRRYAGGKPLPPGPTPLPLIGNLHLVGGGTFHHKLRDLARVHGPVMTLKLGLATNVVISSREAAIEAYTKYDRHLAARATPDTFRACGFADRSMVFIPSSDPQWKALRGIHASHVFTPRVLAAVRPIRERKVGDLIAYLRAHAGEEVLVGHAMYTGILNMVSFSYFSVDIVDMGSQMARELREVVDDIILVVGKPNVSDFYPFLRPLDLQGLRRWTTKRFNRVFSIMGDIIDRRLAHIRDNKPRHDDFLDSILELMAAGKIDRVNVLNMLFEAFVAGADTMALTLEWVMAELLKNPSVMAKARAELRDVLGDKEIVEEADAARLPYLQAVLKEAMRLHPVGALLLPHFAMEDGVEVGGYAVPKGSTVLFNAWAIMRDAAAWERPDEFVPERFVERTPQLDFRGKDVEFMPFGSGRRLCPGLPLAERVVPFILASMLHTFEWELPGGMTAEELDVSEKFKTANVLAVPLKAVPVLIK

SEQ ID NO: 67504 - protein, 477 aa, Vitis pseudoreticulata
MYETDVGIITGKTFPTFDPRTGEVIANVAEGDAEDINRAVSAARKAFDEGPWPRMSPYERSRILLRFADLAEKHNDELAALETWNNGKPYEQAAKAELPLFVRLFRYYAGWADKIHGLTVQADGPHHVQILHEPIGVAGQIIPWNFPLMMFAWKVGPALACGNTIVLKTAEQTPLTALFAAKLFHEAGLPPGVLNIVSGYGPTAGAALASHMDVDKIAFTGSTDTGKIVQELAAKSNLKPVTLELGGKSPFIVCEDADIDQAVELAHFALFFNQGQCCCAGSRTFVHESVYDEFIEKAKARALSRTVGDPFKKGIEQGPQIDPEQFAKVLRYIKSGVESNATLECGGGRIGSKGYFVQPTVFSNVQDDMLIAKDEIFGPVQSILKYKDLDEVIRRANSTRYGLAAGVFTKNINTANTLTRALRVGTVWVNCFDVFDAAIPFGGYKMSGVGREKGIYNLNNYLQVKAVITPLRNPAWL

SEQ ID NO: 67505 - protein, 173 aa, Brassica napus
MGTYLSSPKTEKLSEEGENDTLRYGLSSMQGWRATMEDAHAAILDVDDKTSFFGVYDGHGGKVVAKFCAKYLHQQVLSNQAYGAGDIETSLQRAFFRMDDMMQGQRGWRELAALGDKMNKFSGMIEGFIWSPRSGGDVNNQPDNWPLEDGPHSDFTGPNCGCTACVALIKDKK

SEQ ID NO: 67506 - protein, 281 aa, Arabidopsis thaliana
MAADNAYLMQFVDETSFYNRIVLSHLLPANLWEPLPHFLQTWLRNYLAGTLLYFISGFLWCFYIYYLKINVYLPKDAIPTIKAMRLQMFVAMKAMPWYTLLPTVSESMIERGWTKCFASIDEFGWILYFVYIAIYLVFVEFGIYWMHRELHDIKPLYKYLHATHHIYNKQNTLSPFAGLAFHPVDGILQAVPHVIALFIVPIHFTTHIGLLFMEAIWTANIHDCIHGNIWPVMGAGYHTIHHTTYKHNYGHYTIWMDWMFGSLRDPLLEEDDNKDSFKKAE

SEQ ID NO: 67507 - protein, 828 aa, Escherichia coli CFT073
MKLSRRSFMKANAVAAAAAAAGLSVPGVARAVVGQQEAIKWDKAPCRFCGTGCGVLVGTQQGRVVACQGDPDAPVNRGLNCIKGYFLPKIMYGKDRLTQPLLRMKNGKYDKEGEFTPITWDQAFDVMEEKFKTALKEKGPESIGMFGSGQWTIWEGYAASKLFKAGFRSNNIDPNARHCMASAVVGFMRTFGMDEPMGCYDDIEQADAFVLWGANMAEMHPILWSRITNRRLSNQNVTVAVLSTYQHRSFELADNGIIFTPQSDLVILNYIANYIIQNNAINQDFFSKHVNLRKGATDIGYGLRPTHPLEKAAKNPGSDASEPMSFEDYKAFVAEYTLEKTAEMTGVPKDQLEQLAQLYADPNKKVISYWTMGFNQHTRGVWANNLVYNLHLLTGKISQPGCGPFSLTGQPSACGTAREVGTFAHRLPADMVVTNEKHRDICEKKWNIPSGTIPAKIGLHAVAQDRALKDGKLNVYWTMCTNNMQAGPNINEERMPGWRDPRNFIIVSDPYPTVSALAADLILPTAMWVEKEGAYGNAERRTQFWRQQVQAPGEAKSDLWQLVQFSRRFKTEEVWPEELLAKKPELRGKTLYEVLYATPEVSKFPVSELAEDQLNDESRELGFYLQKGLFEEYAWFGRGHGHDLAPFDDYHKARGLRWPVVNGKETQWRYSEGNDPYVKAGEGYKFYGKPDGKAVIFALPFEPAAEAPDEEYDLWLSTGRVLEHWHTGSMTRRVPELHRAFPEAVLFIHPLDAKARDLRRGDKVKVVSRRGEVISIVETRGRNRPPQGLVYMPFFDAAQLVNKLTLDATDPLSKETDFKKCAVKLEKV

SEQ ID NO: 67508 - protein, 211 aa, Vibrio vulnificus CMCP6
MSFKTAEVSSLAERINWEKVDGLVPAIVQDFQSSQVLMMGYMNQEALVKTGETGQVTFFSRTKERLWTKGETSGNVLQLVNMSLDCDNDTLLVKVNPIGPTCHTGTTTCWDGDPQEESQMVWLHQLEQLLAARKSAGPDSSYTASLYARGTKRISQKVGEEGVEVALAATSGDKAELVCESADLIYHLLVLLQDQGLSMNDVINKLKERHK

SEQ ID NO: 67509 - protein, 239 aa, Thiobacillus denitrificans ATCC 25259
MPKGKSKSAARLPVFDLNGRDGVPDVRIVGFKAHNLIRMAAMGLPVPQGFVMGTDWCGAIRNGEGVKVHLPDALQSGIRDLERATGLGFGSARRPLLVSVRSGAPVSMPGMMETVLNVGLNDVSLAGLLRLTGDHRLVWDSYRRLIQAFAEIVAVIPAEPFEAALDATLRRAGADVARQLDFQALRDLAHIYLDLYHGHTGREFPQDPFEQLWMACRRLKALLGKVISNCIKFWKALET

SEQ ID NO: 67510 - protein, 357 aa, Vibrio vulnificus CMCP6
MSKQQKILFIDRDGTLIVEPPVDFQVDRLDKLKLEPFVIPSLLSLQDAGYRLVMVTNQDGLGTDSYPQEDFDAPHNMMMEIFESQGVKFDDVLICPHFEKDNCSCRKPKLGLVKEYLQAGKVDFQNSFVIGDRQTDLQLAENMAIRGIQYNPEIMGWKRILKDLTVKARVAEVVRTTKETDIKVFVNLDEQGGNAISTGLGFFDHMLDQIATHGGFQMVCKVEGDLHIDDHHTVEDTALALGQALKEALGDKRGIGRFGFSLPMDECLAQCALDLSGRPYLKFDAQFSREQVGDLSTEMVVHFFRSLTDTLACTLHLSSAGNNDHHIIESLFKAFGRTLRQAIKVEGTELPSSKGVL

SEQ ID NO: 67511 - protein, 193 aa, Coccidioides immitis RS
MAEIRRKLVIVGDGACGKTCLLIVFSKGTFPEVYVPTVFENYVADVEVDGKHVELALWDTAGQEDYDRLRPLSYPDSHVILICFAIDSPDSLDNVQEKWISEVLHFCSGHPIILVGCKKDLRHDARTIEELHKTSQKPVTPEQGEEIRKKIGAYKYLECSARTGEGVREVFECATRAALLAKTEKKKKLCKIL

SEQ ID NO: 67512 - protein, 360 aa, Glycine max
MAHNSDSATSNLLLLCSENSSTCFDDDGLECDAADGSNSRISHHEGGGGSELLLACFVAQSEEAVRAMVEREKEHLPRDDYLMRLRSGGLDLDLLGVRKEALDWIWKAHSYLGFGPLSFCLAVNYLDRFLSVFELPRGVSWTVQLLAVACLSIAAKMEEIKVPQSVDLQVGELKFLFEARTIQKMELLVLSTLRWKMCAITPCSFIDYFLGKITCEQHPAKSSISISVHLILGIIRGIDFLEFWPSEIAAAVAASVLKESQVIEIDKAITDLLVVEKGRVLKCVELIRDLSLINVAASLGSKVPYVPQSPIGVLDAGCLSYKSDELTVGSSCPNSSHNTSNPNPTKRSKPDEPSNGTSNS

SEQ ID NO: 67513 - protein, 669 aa, Prochlorococcus marinus str. MIT 9303
MVAATASLDTLCINSIRMLAVDAVNKANSGHPGLPMGCAPMGYTLWDQFLHHNPKNPQWFNRDRFVLSAGHGCMLVYSLLHLTGYDSVSIEDIKQFRQWGSRTPGHPETFETPGVEVTAGPLGAGISNAVGLAIAEAHLAAKFNKPEAKIVDHFTYVVMGDGCNQEGISSEACSLAGHLKLGKLIALYDDNHITIDGRTDVSFTEDVLKRYEAYGWHVQHVANGDTDVNAIAKAIAAAKAVTDKPSIIKVTTTIGYGSPNKSDTAGVHGAPLGEEEATLTRQQLGWNYGPFEIPQEAYDQYRKAIDQGARLESEWNQALANYRSQYPNEAAEFERMLRGELPKGWDKDLPTYTPEDSGLATRKHSQICLGALGPNLPELIGGSADLTHSNYTDIKGETGSFQPETPEKRYLHFGVREHAMAAILNGIAYHNSGLIPYGGTFLVFADYMRGSMRLSALSELGVIYVLTHDSIGVGEDGPTHQPVETIPSLRAMPNMLVFRPGDGNETSGAYKLAIQNRKRPSSLCLSRQGMANQANSSIENVALGGYVLEDCEGTADLILIGTGTELDLCVQAAKQLSAAGHKIRVVSMPCVELFEEQSSAYKQEVLPNAVRKRIVVEAAESFGWHKYIGIDGDSVTMNSFGASAPGGTCMEKFGFTVENVVAKSKALLN

SEQ ID NO: 67514 - protein, 478 aa, Ralstonia solanacearum GMI1000
MSKQFDVLVIGAGPGGYIAAIRAGQLGLNVACCEDNAYDDPKGEPRLGGTCLNVGCIPSKALLASSEEFENVNHHLADHGITVDGARVDVAKMLKRKDDIVGKMTKGIEFLFRKNKVTLLKGHGKFVGKTDAGYQVEIAGKAGTEVVTAKHVIIATGSKARHLPGVPVDNVTIADNEGALKFGEVPKKLGVIGAGVIGLELGSVWRRLGSDVTILEALPSFLGAADESVAKEANKLLNKQGLKINVGVKVGEIESSAKGVKVNYTDATGAAQVLECDKLIVSIGRVPNTDNLGLDAIGLATDQRGFIEVDDHCATKLPNLWAIGDVVRGPMLAHKAEDEGVAVAERIVGQKPHIDYNCIPWVIYTFPEIAWVGKTEQQLKAEGREIKAGQFPFMANGRALGMGASDGFVKVIADAKTDEILGVHVVAANASDLIAEAVVAMEFKAAAEDIGRICHPHPSMSEVMREAALAVDKRQLNM

SEQ ID NO: 67515 - protein, 326 aa, Gibberella zeae PH-1
MRARFKGPAGTGILELPDDATVQALFDEIRMKTGISKFGVRYGLPMAMKSLEATQGDQIARSLGLHGETLTIVPEESSSAPVETVPTGTPQSQVTASKTSKKNESPEDVNVPWPQREGTLQEYSEAVLGSPPSQYCRSIQDPDRWGGGIELSILSSIFDIQICTFDVQTQSKIEFGEEKQDRCILVYSGIHYDRVAFSCTDPPYNSPTLPPEYDQAVWPTGDDDVLKKTKELIQKLNKAHYYTDTNGLILRCDVPGCDWIGSGQLEGQKHAEATGHVDLSEIQDEGDSILRKCDAPGCDFIGQGDKAVRQHRADTAHQSFSVIHDA

SEQ ID NO: 67516 - protein, 820 aa, Methylococcus capsulatus str. Bath
MSKPKLVLVGNGMAGVRTLEELLKLAPGKYDITVFGAEPHPNYNRILLSPVLAGEKKLDDIILNDEDWYAGHGITLHKGKTVVAIDRGRRRVRTEDGTVADYDRLLLATGSTPFILPVPGRDLEGVVGFRDIRDVERMLEASEKHRHAVVIGGGLLGLEAANGLKKRGMNVTVAHLLDTLMERQLDKPAAALLQRALENSGLSFKLEAQTEALLGEGRVRAVRFKDGSEIPADLVVMAVGIRPNIELAKAAGIHCERGILVSDTMQTFDPQVYAVGECVQHRGELFGLVAPLFEQAKVCANHLAEFGIARYRGSVTSTKLKVTGIDLFSAGEYQGGPGFEELLFQDPSRGVYKKLVVRDNKVAGAVLYGDTVDGAWYFQMMRDGTDISAFREHILFGQAHVGDSGHGAESHAARLAEDAEVCGCNGVCKKTIVDAIIQKKLFTLDEVRAHTKASASCGSCTGLVEQLLQSTLGSDYSVSPAKKPLCRCTDLTHEEVREAVRTHGPKTIPQLMGALGWRTPDGCHTCRPALNYYLLCQWPGEYRDDPQSRFINERVHANIQKDGTYSVVPRIWGGVTNPRELRAIADVAEKFRVPCVKITGGQRIDLLGVPKARLPAIWAELGKHGLVSGHAYGKSLRTVKTCVGKEWCRFGTQDSTTLGIELEKMTWGSWTPAKVKMAVSGCPRNCAEATIKDFGVVAVDSGWELHVGGNGGVKVRATDFLCKVQTDEEVMEYAAAYLQLYREEARYLERTAHWIERVGLPYVHSRIVDDAEGRKALRARFLESQRKAQIDPWAERAQGAERHEFEPLTLRERNNHACIA

SEQ ID NO: 67517 - protein, 162 aa, Glycine max
  misc_feature (20)..(20): Xaa can be any naturally occurring amino acid
  misc_feature (85)..(85): Xaa can be any naturally occurring amino acid
  unsure (1)..(162): unsure at all Xaa locations
MPSPSDHHRPQPKPNPNLLXLFLKPIIMLLLTSLFFLFFGFAAFLLLNLFLLGGAFHRLRFRPSVTTAPTSSNGLPPREINKLPXFVCLDAFHNAQWCRKLAACGHVFHRRCVDTWLLKVAACPTCRTPVGFNAGATVHDPPQRSDHLHTCGTDSNALTTLL

SEQ ID NO: 67518 - protein, 934 aa, Pichia jadinii
MFYHGASANQHWIAVDDLSKVPVDVDHYNVVPFQFRRAGEYKEPVLSGIVELDEVKFVVSQSDAAEQWQQLTAEDGTVWRSRAYHGKLGKYSDMAVGAFNKVLNLVRGAETFDIALVTCAYIAMFYTLFNLFARMRAVGSKVWLGLSTLVSSFFAFLFALYITTRVLDLSIPFLSLSEGIPFFVAVVGFNNKILLAEKVLQNQLNAQSSKNDAPTVLYQALREQGPLLLRDHLFMITAFLGCSFYASYLDGLKNFCILAALILAFDILTTSTFLSAILSLKLEINQIHRSTLLREQLEDDGLTETTVDDVLKSNSLAGTKTFTDAPSTLVTVAKVAGVSVFFGLHFYGFGSAWLSDLSAGNETNDTFTLYDAVADQIPIGSNGTLVTLFPTRFFLPEKLSTQIEAVVLSFIGLISTAARDKYISKFILFAFAVSASINVYLLNVARIHTTRLEDAIELKKPKKKASKTAVSVPKAVVVKDSETTKSSEILHSSSESESEQSSRPLEQVIELYKDGKVKTLVDDEVVSLVTAGKLPLYALEKQLGDNLRAVAIRRKAISDLADAPVLRSNKLPYLHYDYDRVFGACCENVIGYMPLPVGVAGPLIIDGKPYHIPMATTEGCLVASAMRGCKAINLGGGVTTVLTKDGMTRGPCVKFPSLKRAGQCKLWLDSDEGQEEMKKAFNSTSRFARLQHLQTALAGDLLFIRFRTVTGDAMGMNMISKGVEYALKQMTEVFGWDDMMVVSVSGNYCTDKKPAAVNWINGRGKSVVAEASIPKDAVVKVLKSSVKAVVDVNVNKNLIGSAMAGSVGGFNAQAANMVTAVYLALGQDPAQNVESSNCITLMTETEDGDLKVSVSMPSIEVGTIGGGTILDPQGSMLELLGVRGPADVPGENARQLAKIVASIVLSGELSLVSALAAGHLVQSHMQHNRAAAKK

SEQ ID NO: 67519 - protein, 483 aa, Oryza sativa (indica cultivar-group)
MSLGYAEKLSYREDVGNVGMPEIFDSPELLHKKIEELAVMVRESKHLVVFTGASISTSSGIPDFRGPKGVWTLQRSGKGVPGATLPFQRAVPTLTHMALVELEKTGRLKFVISQNVDSLHLRSGLPREKLAELHGNSFKEICPSCKKEYLRDFEIETIGLKDTPRRCSDKNCGARLKDTVLDWEDALPPEEMDAAKEQCQTADLVLCLGTSLQITPACNMPLLSLKNGGRVAIVNLQATPKDKKASLVIHGLVDKVIAGVMYMMNLRIPPYIRTDFVQISLRNSVKKKCVRWTLRVTSIHGLRAPLPFLRSVEVSFPERPDMKPVVLKEQPFSLQRETSMNRPFVMLLTFNFSDGCGCSSSSIEWPVDFLKQKDSFVRDRSLVLQELQHAAEHRSRAGQHAILEREGVPRAETSIHALVTNIVRYDTEDSKAAVPMATWMNSNGSLSKRHMDAIGCNPASSKKQKLVANRHRRKGLNPATQKV

SEQ ID NO: 67520 - protein, 879 aa, Methylococcus capsulatus str. Bath
MSPQFRQTVHTTCPYCGVGCGVLATVTDAGVKIQGDPDHPSNFGRLCSKGSALGETLSLGTRLLHPEIGGIRTGWDEALDTVAGRFRETLERYGPDSVAFYVSGQLLTEDYYVANKLMKGFIGSANIDTNSRLCMSSTVAGHKRAFGEDLVPGCYEDLELADLVVLVGSNTAWCHPVLFQRILAARRADPKRRIVCIDPRRTATAEAADLHLPIRPGTDVLLFNGLLHYLRHNDCLDFEFIERHTEGYAAALNMAKETAPTVPSVAAGCGLAESEVAQFYRLFAANERTVTLWSQGVNQSTQGTDKVNAILNVHLATGRIGKPGAGPFSLTGQPNAMGGREVGGLANQLAAHLDLDDPGHRRQVQEFWRSPRIADRPGYLAVDLFRAIGEGRIRAVWIMATNPAVSLPDVHAVRRALSACPFVVVSDCERDTDLSRFAHVQLPALAWGEKDGTVTNSERRISRQRAFLDAPGEARPDWWIIAEVARRMGFGAAFDYRSAADIFAEHIALSRIAGAEKRRFDLSGLQTAYDELAPTQWPVDAGNPQGTPRLSFDGRLTFVAVRPQAPAHAPDTGYPLILNTGRIRDQWHTMTRTGKTQRLTGHLPEPFAEVHPIDGSRLELTDGALARLESRYGSALVRVRFSAGQQPGTVFTPMHWSESNSRQGLVNALVNPAVDPVSGEPEFKHTPVRVVPYRPRWYGFAIARRRIEFPDAAYRVVIPARHCWRHELAGEVLSEDWQRWARERLGPEGDGWDDWLEFADPRAGRYRCAWIVQGRIEFALFVSPSHELPPRDWLVSLFGQDALSETARAGLLAGRPLSADDDRGRIVCACFAVGENTLRRTIASETLTTAEQVGTSLKAGTNCGSCLPEIHALLAEAQH

SEQ ID NO: 67521 - protein, 378 aa, Haemophilus influenzae R2846
MEIKQINSTIKSRAAVAFAPNQPLQIVEIDVEMPRKGEVLIRNTHTGVCHTDAFTLSGSDPEGVFPVVLGHEGAGVVVAVGEGVLSVKPGNHVIPLYTAECGECEFCLSGKTNLCVSVRDTQGKGLMPDGTTRFSCQGKPIYHYMGCSTFSEYSVVAEVSLAKINPEANHEQVCLLGCGVTTGIGAVHNTAKVQEGDSVAVFGLGAIGLAVVQGARQAKAGRIIAIDTNPAKFELAKQFGATDCLNPNDYDKLIKDVLLDINKWGIDHTFECIGNVNVMRQALESAHRGWGQSIIIGVAGAGQEISTRPFQLVTGRVWKGSAFGGVKGRSELPQMVEDSMKGDIQLEPFVTHTMPLDQINEAFELMHEGKSIRTVIHY

SEQ ID NO: 67522 - protein, 442 aa, Oryza sativa (indica cultivar-group)
MAKNNVKAESMARPSPVEASGGLVMRDITGGGGELRVQIAANSGGQGGKVVGAAPEKWLNRFVRMVALMERTGNALGTLAFTWATVVLLGGYPKGTHNVVKNQVQQASWLQSAPISFQGFRPQESWMHSPNQVVGSASSHGSESASQCPARQEENNLVNIEESSDNSQETGRRGTRVNWTEEENLRLLSSWLNNSLDSINGNDKKGEYYWRDVAAEFNGNASSNNRKRTVVQCKTHWGGVKKDIAKFCGAYSRARRTWSSGFSDDMIMEKAHALYKSENNDKTFTLEYMWRELKDQPKWRRILEEDSKNKRTKISESGAYTSSSNQETEEETSRKEKRPEGQKKAKAKLKGKGKKPAPSPLGDQPSQDFVLFNEAVKLRAEAVLKSAEATTKSAEAKKEQTRMEKYQTYLKLLDKDTANFSDAKLKRHEAVLEKLATELAEE

SEQ ID NO: 67523 - protein, 500 aa, Coprinopsis cinerea okayama7#130
MPSTFSYQWDTPAYKGKTEFNTGLFINGQFVDGSNKTTIDVVNPTNGKVITSISEGVEKDVDLAVEAAQKAFETTWGLNVSGSQRSELLWKLATLMEQHHEELAAIEATDNGKTFAWAKGTDVAFSINVIKYFAGWADKITGQTIETDERKLIYTRHEPIGVVGQIIPWNFPLLMLAWKIGPALATGNTIVLKPSEFTPLTAIRMCSLIQEAGFPPGVVNIVTGYGNTVGAAISSHPKIEKVAFTGSTLVGRKIMEAAAKSNLKNVTLELGGKSPNVIFNDADIDQAVNWAVHGLFWNHGQACCAGSRIFVQSGIYDEFLKRFTAKAAAIRVGDPFGVEVDQGPQVSQIQYDRIMGYIDSGKADGATVHLGGKRHGQEGYFIEPTIFTDVKPDMKIVREEIFGPVGVLIKFEDEADVIRQANDTVYGLAAAVFSQNINRAIETAHKMQAGTVWVNCANQLHANVPFGGFKQSGIGRELGEYALHNYTNVKAVHVNIGHVM

SEQ ID NO: 67524 - protein, 171 aa, Solanum sogarandinum
MANPRVFFDLTIGGASAGRVVMELFADTTPKTAENFRALCTGEKGIGKMGKPLHYKGSTFHRVIPGFMCQGGDFTAGNGTGGESIYGAKFKDENFVKKHTGAGILSMANAGPGTNGSQFFICTAKTEWLDGKHVVFGQVVEGLDVIKKTEAVGSSSGRCSKPVVVADCGQL

SEQ ID NO: 67525 - protein, 449 aa, Streptococcus agalactiae 2603V/R
MSKQYDYIVIGGGSAGSGTANRAAMYGAKVLLIEGGQVGGTCVNLGCVPKKIMWYGAQVSETLHKYSSGYGFEVNNLNFDFTTLKANRDAYVQRSRQSYAANFERNGVEKIDGFARFIDNHTIEVNGQQYKAPHITIATGGHPLYPDIIGSELGETSDDFFGWETLPDSILIVGAGYIAAELAGVVNELGVETHLAFRKDHILRGFDDMVTSEVMAEMEKSGISLHANHVPKSLKRDEGGKLIFEAENGKTLVVDRVIWAIGRGPNVDMGLENTDIVLNDKGYIKADEFENTSVDGVYAIGDVNGKIALTPVAIAAGRRLSERLFNHKDNEKLDYHNVPSVIFTHPVIGTVGLSEAAAIEQFGEDNIKVYTSTFTSMYTAVTTNRQAVKMKLITLGKEEKVIGLHGVGYGIDEMIQGFSVAIKMGATKADFDDTVAIHPTGSEEFVTMR

SEQ ID NO: 67526 - protein, 387 aa, Kluyveromyces lactis NRRL Y-1140
MFRSAILRAGKVSPRTIVQPQLFGTQRVAWTGFSSIRFNSSDSSAVSDAAAGAASKVSEIQTQLPSFDENTIETVSQVGQVIGDASNQIGYLSSIGMAKSWLWPPDLIQNVMEQIHFYAGLPWWATICVTTVLARVLLFPLYVKYSDTLGRTSKIKPEMDKVNADLMACSDTTKAQQIAMKRRKLLSENGIKNRYLIVPVVQIPIAISFFTSIREMCLYPVDGLATQGIAWFQNLTLADPYLGLQCLTAAMFVALARKGGESGAQQFSPQMKKVFTYLPILTIPVTMNLSAGVVLYLAVNGVCSMIQTLLLRNQTARKFLNIAEVVNHPAPENQGPQKGVFESFRENIQKAKDQAEKRAMMKEQDDKMKDLAKKEKENQRIKIVRKK

SEQ ID NO: 67527 - protein, 379 aa, Bacillus anthracis str. A2012
MKVGQQVALMKVDGSVKQFRVTKLFGYMGLKRQEIEEAKAGDLVAVSGMEDINVGETVCPVEHQDALPLLRIDEPTLQMTFLVNNSPFAGREGKYITSRKIEERLRSQLETDVSLRVDNTESPDAWIVSGRGELHLSILIENMRREGYELQVSKPEVIIKEVDGVRCEPVERVQIDVPEEYTGSIMESMGARKGEMLDMVNNGNGQVRLTFMVPARGLIGYTTEFLTLTRGYGILNHTFDCYQPVHAGQVGGRRQGVLVSLETGKASQYGIMQVEDRGVIFVEPGTEVYAGMIVGEHTRENDLTVNVVKMKQQTNIRSATKDQTSTMKKPRLMTLEESLEYLNDDEFCEVTPESIRLRKKILDKSERERAAKKKKSVEA

SEQ ID NO: 67528 - protein, 377 aa, Glycine max
MMACQDWPEPVIRVQALAESGLTTIPERFIKPKSQRPTNNNNYAPKVNFSQIGHHENTTTTNNNNTNIPVIDMKHIYGGDERRRAETLRLVSEACREWGFFQVVNHGVSHELMKGAREVWREFFQQPLEVKEVYANTPLTYEGYGSRLGVNKGAILDWSDYFFLHHMPCSLRDQAKWPALPTSLRNIISEYGEQVVMLGGRILEILSINLGLREDFLLNAFGGENDLGACLRVNFYPKCPQPDLTLGLSPHSDPGGMTILLPDENVSGLQVRRGEDWITVKPVPNAFIINMGDQIQVLSNAIYKSIEHRVIVNSNKDRVSLAFFYNPRSDIPIQPAKELVTKDRPALYPPMTFDEYRLYIRTRGPSGKAQVESLTSE

SEQ ID NO: 67529 - protein, 451 aa, Brassica napus
VDPASEKLYGEFLVNAQGEDVVAGIRTPEDLDTMKRLMPQAYAELVENCDILEGHYKDMMDIEFTVQEERLWMLQCRAGKRTGKGAVKIAVDMVGEGLVDKSTAIKMVEPQHLGRLLHPQFHDVSGYREKVVAKGLPASPGAAVGQVVFTAEEAEVWHSQGKNVILVRTETSPEDVGGMHAAEGILTARGGMTSHAAVVARGWGKCCIAGCSEIRVDENHKVLLIGDLTINEGEWISMNGTTGEVILGKQALAPPALSADLETFMSWADSVRRLKVMANADTPEDATAARKNGAEGIGLCRTEHMFFGADRIKAVRKMIMAVTTEQRKASLDVLLPYQRADFEGIFRAMDGLPVTIRLLDPPLHEFLPEGDWMLIVQELAAETGMKEDVILSQVEKLSEVNPMLGFRGCRLGISYPELTEMQARAIFEAAASMQDQGVTVLPEIMVPLVGT

SEQ ID NO: 67530 - protein, 288 aa, Brassica napus
LLRIREIATPEEEVALIEDYVSDSVDHHGFPAGKLSTGGWRSAWYIIGVEVGERFAYFGIASNLITYLTGPLGQSTATAAVNVSTWSGTASMLPVLGAFIADAYLGRYHTIVVASLIYILGLGLLTLSAFLILIRISEQRNDTVKSFFWVNILFFCSLYMVAIGQGGHKPCVQAFGADQFDSGDSKERISRGSFFNWWFMTLSAGITLSFLVVVYVQDNVSWALGFGIPCVFMVMALALFLLGRKTYRYPRGNHTEKKNAFARIGRVFVAAYKNRKLNLSDSSLSQSL

SEQ ID NO: 67531 - protein, 499 aa, Clostridium perfringens SM101
MEIFSSNSIRNMDKDYIEKFNMPSIVLMENAIIKFLENIDLTKESFTIISGRGNNGGDALGIARHLLNKGKKVYVHILEKEKEGSVDYKTNLTILENLGCYINSISNNKDLEILKNNIINSEIIIDGIFGTGLNKEIAGIYFDTIKCINENSKFTVSIDVPSGINSDDGSICGIAIKANKTISFQVYKLGFLNYKSFEYLGDLKIVDIGIPKSIVYKNSNNMRFIDKEYIRNIFPYRNKYGHKGTYGRSLIFAGQKGFIGAAYMVGEAAIKTGAGLVTVFTHKDVQSELSIKLNEGMTGTYNSKEEYEEFIGGADVIAFGPGMGNNDLTFEVLNNICNLYSGALVIDADGINVLERKKYILKEFKGDIVLTPHPGEMARLLGIEIKDVERDRIGIAKKFAKENKVTVLLKGYNTIITDGDKVFVNPTGSSAMASGGMGDTLTGIITSLISQGVNSFDAAILGAYIHGYIGDELSKENFTVSAMEIIKNIPNKIKELINF

SEQ ID NO: 67532 - protein, 799 aa, Xylella fastidiosa Temecula1
MALNGASYLNENILWLHELRLTDLARVGGKNSSLGEMIGNLTALGVSVPGGYATTAAAFKAFIAYNNLSKRIYDKLATLDVEDVKALTAAGKEIRDWVIDAPLQPELEKDIRDAYDTLSKDNSGNDVAVAVRSSATAEDLPDASFAGQQETFLNVIGADQVVHKIKEVFASLYNDRAIAYRVHHGFKHEDVFLSAGIQLMVRSDISASGVLFTLDTESGFREVVFVTASFGLGEMVVQGAVNPDEFYVYKKTLKAGKPAILRRTLGTKLVRMVYSDAPGERVKIEDTPTELRHCFAISDADVQELARQALIIEQHYGRPMDIEWAKDGISGKLFIVQARPETVKSRSHTTQIERFALQQPGQILTEGRAIGQKIGSGTARVVNSLEDMHHMQPGDVLVADMTDPDWEPVMKRASAIVTNRGGRTCHAAIIARELGVPAVVGTGNALSIIQDGQPITVSCAEGDTGYIYAGKLPFERTTTDLGHMPPAPLKIMMNVANPERAFDFGQLPNAGIGLARLEMIIAAHIGVHPKALLEYHKQDADTKQKIDAKIAGYPDPVSFYVNRLAEGIATLTASVAPHTVIVRLSDFKSNEYAHLIGGQHYEPQEENPMLGFRGASRYVDPSFSDAFALECKAVLKVRNEMGLDNLWVMIPFVRTLEEGRKVIDVLRQNGLKQGENGLKVIMMCEVPSNALLADEFLDIFDGFSIGSNDLTQLSLGLDRDSSIVAPLFDERNPAVKKLLSMAIKAARSKGKYIGICGQGPSDHPDLAEWLMQEGIESLSLNPDTVVDTWLRLAKLKTVH

SEQ ID NO: 67533 - protein, 374 aa, Aspergillus nidulans FGSC A4
MAFFFNRGRSRQPSDVVRSIKDLLLRLREPSTASKVEDELAKQLSQMKLMVQGTQELEASTDQVHALVQAMLHEDLLYELAVALHNLPFEARKDTQTIFSHILRFKPPHGNSPDPPVISYIVHNRPEIIIELCRGYEHSQSAMPCGTILREALKFDVIAAIILYDQSKEGEPAIRLTEVQPNVPQRGTGVFWRFFHWIDRGTFELSADAFTTFRARYLATNFDYFFAQFNTFLVQSESYVTKRQSIKLLGEILLDRANYSVMMRYVESGENLKLCMKLLRDDRKMVQYEGFHVFKVFVANPDKSVAVQRILINNRDRLLRFLPKFLEDRTDDDQFTDEKSFLVRQIELLPKEPIEPSRSAREPSRSTANTTTVA

SEQ ID NO: 67534 - protein, 512 aa, Oryza sativa (japonica cultivar-group)
MEKLKSELWMTAVATCMSLLLYLTILRRRHASGGRSLALPPGPTPLPLIGNLLCLGGIFHQTLAKLARVHGPVMTLKLGLTTAVVVSSAEAAREAYTKHDQRLAARPVPDAFRANGFSERSIVFSPSSDPQWKNLRGIHATHIFSPRALAALRGIRERKVRDIVGYIRTVAGEEMCVREVVHNGVLNLISTSFFSMDMADVRSESARGLRGLIEDIIATVAGPNVSDFFPFLRQLDLQGLRRQTGSHLGIVFGLLDDIIDRRMAETRDHPDKQRHGDFLDALISLASAGKIPRYHITYLLFDVFAAGADTMTTTVEWAMAELLRNPRVMAKVRAEVTDALGGRESFDEGDAASLTYLQCVFKEAMRLHPVGSILVPHLAVQDGVEIGGYAVPKGTTVIFNAWAIMRDPAAWESPDQFLPERFLHKEESSSPPLELRGKDYEYIPFGSGRRLCPGLPLAERAVPFILASLLHAFEWRLPDGMSPDDMDMTEKFATANVLATPLKAVPVASHTS

SEQ ID NO: 67535 - protein, 166 aa, Triticum aestivum
  misc_feature (114)..(114): Xaa can be any naturally occurring amino acid
  unsure (1)..(166): unsure at all Xaa locations
MAMAASWWALLMAVVAAAAAGCGEAAPTAAAEAAHDVLQSHGLPRGLLPAGIAAFTHDPATGRFEAVLESPCTARTEVGLRYNVTVAGQITYGRIAELSGVDAQDLFLWFAVRXFRVDVPSSGVIYFVVGVLYKHLPLSFFEARPPCVPPSLSSCNHIRFRDTDHW

SEQ ID NO: 67536 - protein, 305 aa, Sulfolobus shibatae
MPLDPRIKKLLESGFVVPIGKASVDEVRKIFRQLASAAPKAEVRKVEDIKIPGSETSINARVYFPKAKGPYGVLVYLHGGGFVIGDVESYDPLCRAITNACNCVVVSVDYRLAPEYKFPSAVIDSFDATNWIYNNLDKFDGEMGIAIAGDSAGGNLAAVVALLSKGKLDLKYQILIYPAVGFDSVSRSMIEYSDGFFLTREHIEWFGSQYLRSPADLLDFRFSPIIAQDLSGLPPALIITAEYDPLRDQGEAYANRLLQAGVPVTSVRFNNVIHGFLSFFPLIDQGKDAIGLIGSVLRRTFYDKS

SEQ ID NO: 67537 - protein, 368 aa, Burkholderia xenovorans LB400
MKTYRIATIPGDGIGKEVVPAGRRVLEAIAARSDAFGFEFENFDWGGDYYREHGVMMPADGLDAIRHQDAILFGSAGDPHIPDHVTLWGLRLKICQGFDQYANVRPTRILPGIDAPLKRCGPQDLDWVIVRENSEGEYAGVGGRVHQGHPIEVATDVSMMTRAGVERILRFAFRLAQSRPRKLLTVITKSNAQRHAMVMWDEIAVQVSKEFPDVRWDKELVDAATARMVNRPATLDTIVATNLHADILSDLAAALAGSLGIAPTANLDPERRYPSMFEPIHGSAFDIMGKGLANPVGTFWSVVMMLDHLGEHAAARQLMAAIERVTADPSLHTGDLGGTATTAQVTDAVCAILAAGSPAVPAASVKAA

SEQ ID NO: 67538 - protein, 420 aa, Arabidopsis thaliana
MNSLPRRFGKNHGYLDRDYRNGRRSGSDSDEELKGLSHEEYRRQKRLKMRKSAKFCFWENTPSPPRDQNEDSDENADEIQDKNGGERDDNSKGKERKGKSDSESESDGLRSRKRKSKSSRSKRRRKRSYDSDSESEGSESDSEEEDRRRRRKSSSKRKKSRSSRSFRKKRSHRRKTKYSDSDESSDEDSKAEISASSSGEEEDTKSKSKRRKKSSDSSSKRSKGEKTKSGSDSDGTEEDSKMQVDETVKNTELELDEEELKKFKEMIELKKKSSAVDEEEEEGDVGPMPLPKAEGHISYGGALRPGEGDAIAQYVQQGKRIPRRGEVGLNAEEIQKFEDLGYVMSGSRHQRMNAIRIRKENQVYSAEDKRALAMFNYEEKAKREAKVMSDLQRLVQRHMGEEVGPNHDPFGAGKTEEDDD

SEQ ID NO: 67539 - protein, 615 aa, Oryza sativa (japonica cultivar-group)
MASISGAAAAAPSSSGASCGLRLRRDHLPRSSHFRLARPSSITDVSRSCSSSSSSPPRSLSSKQSGHADVLAHGAVDKDPIRLWNRYVEWLYQHKQLGLFVDVSRIGFTEEFLRRMEAPMGRAFAAMRELEKGAIANPDEGRMVGHYWLRNPALAPNSFLRDKIETTLERILAFASDVISAKIRPPSSPAGRFTQILSIGIGGSSLGPQFVAEALAPDNPPLMIRFIDNTDPAGIDHQIAQLGPELASTLVIVISKSGGTPETRNGLLEVQKAFRDAGLEFSKQGVAITQENSLLDNTARIEGWLARFPMFDWVGGRTSEMSAVGLLPAALQGIDIKEMLVGAAQMDEETRNTEIKENPAALLALCWYWASDGIGSKDSLLLLSRYLQQLVMESLGKEFDLDGNRVNQGLTVYGNKGSTDQHAYIQQLREGVHNFFVTFIEVLRDRPPGHEWELEPSVTCGDYLFGMLHGTRSALYANDRESITVTVQEVNPRAVGALVALYERAVGLYAYLININAYHQPGVEAGKKAAGEVLALQKRILLVLNEASCKDPAEPLTLDQIADRCHCPEEIEMIYKIIQHMAANDRALIAEGNCGSPRSIKVYLGECNVDDDMNS

SEQ ID NO: 67540 - protein, 454 aa, Halobacterium sp. NRC-1
MTNGDSSSSALTDNERAVLDDIEAQGIDFLRLQFTDILGTVKNVSIPAHQAEKAFTEGIYFDGSSIEGFVRIQESDMRLDPDPETFAVLPWRSNGDGGSARLICDVVDREGNAFAGGPRQVLKNVLARADDMGYSVSIGPEPEFFLFEKDDDGNATTTAHDQGGYFDLAPKDLASDIRREIIFTLEAMGFEIEASHHEVARGQHEINFKYDDALTTADNIATFRAVVRAVAEQHDVHATFMPKPIGEINGSGMHSHISLFDEDGENVFADNDDEFNLSETAYQFMGGVLEHAPAFTAVTNPTVNSYKRLVPGYEAPVYIAWSGVNRSALIRVPDAAGVSARFEIRSPDPSCNPYLALAAVIAAGLDGIDTDADPGDAVREDIYEFDEDKRDAYGIDTLPGHLGDAVTALESDPVMQDALGEHVCEKFAEAKRHEYAEYKASVSEWETDRYLEKF

SEQ ID NO: 67541 - protein, 524 aa, Oryza sativa (japonica cultivar-group)
MADMKQEEISHPPMDQLQGLEYCIDSNPSWGEAIALGFQHYILCLGTAVMIPTLLVPLMGGNAHDKAKVVQTMLFVTGINTMLQTLFGTRLPTIIGGSYAFVIPVISIIKDPSLAQITDDHTRFIMTMRAIQGALIISSCIQIILGYSQLWGICSRFFSPLGMVPVVALVGLGLFERGFPVIGRCVEIGLPMLVLFVALSQYLKHVQVRHFPILERFSVLISIALVWVYAHILTASGTYKHTSLLTQINCRTDRANLITSADWIDIPYPLQWGPPTFSADHAFGMMAAVVVSLIESAGAFKAAARLASATPPPPYVLSRGIGWQGIGLLFDGLFGTGTGSTVSVENIGLLGSTRIGSRRVIQISAGFMIFFSILGRFGALFASIPFTMFAAIYCVMFGYVGAVGLSFMQFTNMNSMRSLFIIGVSLFLGISIPEYFFRYTMSALHGPAHTRAGWFNDYINTVFSSPPTVGLIVAVILDNTLEVRDAARDRGMPWWARFRTFRGDSRNEEFYTLPFNLNRFFPPS

SEQ ID NO: 67542 - protein, 506 aa, Pseudomonas putida KT2440
MTQYAVARLAQLDEHRPLRVQAGSEELILVRQGEQVHAYQGNCPHAGAPLDEGVVCGGLLVCPWHKATFAVDDGVVCEPPALADLRRYKAWIKGDEVWVDDQPLPATEPPRHSDARCFVVVGAGAAGSAAVATLLAHGFAGRLVWIDQERQPAYDRTALSKFVIAGQMPPDEVPALLEADALRKGQLERKYGKVRTLNSQKRQVTLADGQQIDYDACLLATGGKALRPDIPGADLPGVFTLRSLEDAARLLDAAEPGQPVVIVGDGFIGLEAASALRKYGVQVHVVSRHEVPLARQLGERIGRCIRALHERKGITFHGPTEVERIEGLDKVEAVQLTNGERLQTPLVLLGTGVRPATAFLQGVPLGEDKSVRVDAEMRAADGLWAAGDIATFPLTGRPVRIEHWRLAQQHGVIAAANMLGEQRRYADVPFFWTYQHGRTYEVLGHARDWNRIEFVGEPEKGDFVALQCVDERVEAVIAKGYSDAMATLSQRLKRPLSLQEAWALIG

SEQ ID NO: 67543 - protein, 346 aa, Candida albicans
MTPNGSRRHSAYMGSPRSQHSSTMETGYNPYEAVQKKQELYQNNNGNSPTVIIEEDPYIPNYKELSLANKKTNYNMKIVVVGDGGCGKTCLLLAYTQNKFPSIYVPTVFENYVTAVQSPNGKTVELALWDTAGQEEYDRLRPLSYPDVDILLVCFAVDNEVSLENVKDMWFPEVNHYCPGIPIILVGTKSDLLSDMNHDASIRVAKEIGAIGLIFTSAKTMFNVRTVFNFALNHFQRNMELQEQYEKTLGSRKRISRVLGGSNGGSGNHSRHHSRNYSNVSNNRRGHLKNTSYDSTALLDQPLTEDTYVKNPYGNFGYKANVESPYNQDEFAFTRERKKKKKCVIL

SEQ ID NO: 67544 - protein, 127 aa, Halobacterium sp. NRC-1
MKRPIETADAPAAVGAYSQAATDGDVVFTAGQIPMTPDGELIADEPIDVQTRQSLENVKAILEAEGLNMQDVLKVSVFMDDMDDFDAMNAAYKEYFQDNPPARSAVEVAALPKGVGVEIEAIAAQRD

SEQ ID NO: 67545 - protein, 203 aa, Oryza sativa (japonica cultivar-group)
MFSLAYGLWKYIFNKTEFHVLILGVDKAGKTTLLEKIKSIYLKGEGLTPDRIVPTVGLNIGRIEDANAKLVFWDLGGQVGLRTIWEKYYQEAHAIIYVIDAAAASSFEDAKSALEKVLRHEDLKGAPLLIFANKQDLPGVITDEELARYLQLKELDERPYKFQAVSAYDGRGIKSGIDWVVEQMERSKRTEVLRARAGFTGQI

SEQ ID NO: 67546 - protein, 330 aa, Candida albicans SC5314
MGTMSEDSELIEQVIEQPDSLIISPPSDSSSSSSYNHIQPFVYLESTATTQTNHNVLLILNQKITIDLISLWKKCEIIVCADGGANSLYEYFNDNNHHHHHENLQRSDYIPDYIVGDFDSISPDVKTYYESHGSKIIRQSSQYYNDFTKSIHCIQLHYQLNHTKENWFESIDEVDGLAKLWNGLNNSSDVVVDIDITIYVLNAIGGRFDQTVQSINQLYIMNEDYPKVTVFFITTNDIIFLLKKGVNYISYKNRLMFHKDNGSSPTPTCGLLPLSNKTPIILNSYGLKYDMRNWKTEMLGQVSSSNRISGETGFIVECSDDIVMNIEIDV

SEQ ID NO: 67547 - protein, 339 aa, Pseudomonas putida KT2440
MATTTMTMIQALRSAMDVMLERDDNVVVYGQDVGYFGGVFRCTEGLQNKYGKSRVFDAPISESGIVGTAVGMGAYGLRPVVEIQFADYFYPASDQIVSELARLRYRSAGEFIAPLTLRMPCGGGIYGGQTHSQSPEAMFTQVCGLRTVMPSNPYDAKGLLIASIECDDPVIFLEPKRLYNGPFDGHHDRPVTPWSKHPHSAVPDGYYTVPLDKAAITRPGNDVTVLTYGTTVYVAQVAAEESGVDAEVIDLRSLWPLDLDTIVESVKKTGRCVVVHEATRTCGFGAELVSLVQEHCFHHLEAPIERVTGWDTPYPHAQEWAYFPGPSRVGAALKKVMEV

SEQ ID NO: 67548 - protein, 629 aa, Brassica napus
MSSTYARFDTVFLLSRFAGAKYSPLWPSSSSSSHSSLLSSGIHLRAKPNSRLRSVTGASSSSSGPIIAGSESIEIKSLPTKPIEGQKTGTSGLRKKVKVFMQDNYLANWIQALFNSLPLEDYKDATLVLGGDGRYFNKEASQIIIKIAAGNGVGKILVGQEGILSTPAVSAVIRKRKANGGFIMSASHNPGGPEYDWGIKFNYSSGQPAPESITDKIYGNTLSISEIKVAEIPDIDLSHVGVTKYGNFSVEVIDPISDYLELMEDVFDFDLIRGLLSRSDFGFMFDAMHAVTGAYAKPIFVDNLEAKPDSISNGVPLEDFGHGHPDPNLTYAKDLVDVMYRDDGPDFGAASDGDGDRNMVLGNKFFVTPSDSVAIIAANAQEAIPYFRAGPKGLARSMPTSGALDRVAEKLKLPFFEVPTGWKFFGNLMDAGKLSICGEESFGTGSDHIREKDGIWAVLAWLSILAHRIKDKKPGEKLVSVADVVNEYWATYGRNFFSRYDYEECESEGANKMIEYLRDIVAKSKAGENYGNYVLQFADDFSYKDPVDGSVASKQGVRFVFTDGSRIIYRLSGNGSAGATVRIYIEQFEPDVSKHDVDAQIAIKPLIDLALSVSKLKEFTGREKPTVIT

SEQ ID NO: 67549 - protein, 459 aa, Pseudomonas putida KT2440
MQQIIQTTLLIIGGGPGGYVAAIRAGQLGIPTVLVEGQALGGTCLNIGCIPSKALIHVAEQFHQASRFTEPSPLGISVASPRLDIGQSVTWKDGIVDRLTTGVAALLKKHGVKVVHGWAKVLDGKQVEVDGQRIQCEHLLLATGSSSVELPMLPLGGPVISSTEALAPKTLPQHLVVVGGGYIGLELGIAYRKLGAQVSVVEARERILPTYDSELTAPVAESLKKLGIALHLGHSVEGYENGCLLASDGKGGQLRLEADQVLVAVGRRPRTKGFNLECLDLKMNGAAIAIDERCHTSMHNVWAIGDVAGEPMLAHRAMAQGEMVAEIIAGKARRFEPTAIAAVCFTDPEVVVVGKTPEQASQQGLDCIVAQFPFAANGRAMSLESKSGFVRVVARRDNHLIVGWQAVGVAVSELSTAFAQSLEMGACLEDVAGTIHAHPTLGEAVQEAALRALGHALHI

SEQ ID NO: 67550 - protein, 414 aa, Oryza sativa (indica cultivar-group)
MGWKAPTRIQAEAIPFALQGRDVIGVGQTGSGKTAAFALPIIQALLEHEHRPRFLACVLAPTRELAIQIAKQFEALGSAISLQCSVLIGGIPRTSQTISLAKRPHVVVGTPGRLLDHLTNTKGFSFNKLKYLVLDEADDLLKVDFQKAVDDILNVIPKERRTFLFSATMTEKVKKLRRACLKNPVKVEVASKYSLVDTLRQDLYVVPAKYKDCYLIHVLNKMPGSMIMVFVRTCESTRLLALMLRNLRFKAISISGQMSQDKRLGALNRFRTRDCNILVCTDVASRGLDIQGVDVVINYDFPLNSKDYIHRVGRTARAGQSGYAVSLVNQFEGEFFKLTEQFLGGEEIPARKVDADEIMILHERIYDSKRIALKTMNESGYHKRMRRRMEDDEEEVEEAPVSSRSRSLKKSRRR

SEQ ID NO: 67551 - protein, 456 aa, Haemophilus influenzae R2846
MTKHYDYIAIGGGSGGIASLNRAASYGKKCAIIEAKHLGGTCVNVGCVPKKVMFYGAHIAEAINNYAPDYGFDVEVKKFDFSKLIESRQAYISRIHTSYNNVLAKNNIDVINGFGKFVDAHTIEVTLADGAKEQVTADHILIATGGRPYRPNIKGQEYGIDSDGFFALTELPKRAVVIGAGYIAVELSGVLNSLGVETHLLVRRHAPMRNQDPLIVETLVEVLAQDGIQLHTNSTPSEIVKNADGSLTVKCDGQSDVTVDCAIWAAGRVPATDKIGLENAGVETNEHGYVKVDKYQNTNVKGIYAVGDIIENGIELTPVAVAAGRRLSERLFNNKPTEYLDYSLVPTVVFSHPPIGTVGLTEPQAIEQYGAENVKVYKSSFTAMYTAVTQHRQPCKMKLVCVGKDEKVVGLHGIGFGVDEMIQGFAVAIKMGATKADFDNTVAIHPTGSEEFVTMR

SEQ ID NO: 67552 - protein, 213 aa, Zea mays
MAAASAITAVSGVVLPQTFLSHRSPPPQVLAVASSFHRLSLCASHRRITHIIPRADASAEAGEPEPVTTSAESEEEVAEGSVAVAEAEEPTPPSKPKVKFGEIIGILNKQFIEEAEKVKTVPDLRPGDIIELRMQRPNKRRLSLFKGIIIAKHKAGVHTTIRVRRIIAGVGVEITFPVYSPRIKEITVIRHKKVRRAKLYYLKDKLPRFSTFK

SEQ ID NO: 67553 - protein, 177 aa, Triticum aestivum
LDLCDAFFKGVCFLPLRGEKRKGGLPRGGGPFPSSRGPAVGRVPRGGNLQPKFSGLTLFCPSHQDSVSNRYTSPLVPASPNPNHAVRSTPRGERSDMPATPTIIGALLGLGTQMYSNALRKLPYMRHPWEHVLGMGLGVVFVNQLVKFDEKVKVDLDKMLERAKHANEQRYFDEDDD

SEQ ID NO: 67554 - protein, 400 aa, Roseovarius nubinhibens ISM
MRYSKTITGLTGGGSDGWDIYRKARRMQRDGTEVTMLTIGEHDIRTDAQILDALHRFAHAGHTGYTTFDGEPELKDRIATRLSERTGVPTTPANVLIVPGGQGGLFAAHHAICDPGDTALYIDPYYTTYPGTIRTVGAIPLAIEARPRHGFQPQPEDIARAADAAGNARSLLVNTPNNPTGVVYTRKTLEGIAEICTDKGLWLLSDEVYDTQVWNGDHLSPRALPGMAERTLVIGSMSKSHAMTGSRVGWVVGPEEAIAHMANLATHTTYGISGYIQHAAAFALDLGPAFEEQIAEPFRRRRDLVMAQMEGQNAARPIPADGAMYVMVDIRSTGLSGEAFADGLLDRHHVAVMPGESFGQAAAGHVRVALTVADDLLVAAVARLVELAAELAAQHAEPAQ

SEQ ID NO: 67555 - protein, 402 aa, Arabidopsis thaliana
MFPMSSTSRSSAANNRKDPPRKKNKETPSPVTREPTSIDSLPNDLLLNCFARVSRMYYPALSRVSKRFRSIVTSPEIYNTRSLLNRTEKCLYLCLRFPFDNNTHWFTLYQNPNRTVSDKVFLQIPSPQYPLTLSSNLVAVGSNIYRIGGTVGDDSCPLGFDREPSSKVSILDCRSHTWRDGPRMRLNRRSSTTSVVDGKIYVTGGTEDTDNPSHWIEVFDPKTQSWGTVTNPHIVKVWEEVCYRRAVKSIGHDGKLYLSGDKYVVYDPDEGKWNSVEEHWLIGYAIGSSNCVVDNILFYWDQGVFKWYDSKVSSWKQLKGLEGLPDDFSQREYCKLVDLGGKMAVLWDKWEYSGVCMIFCAEISLEKRDGDEIWGKVEWFDTVLEVGASCSLKSADALSASV

SEQ ID NO: 67556 - protein, 156 aa, Zea mays
MAAAAAAPASVAPSSPKAAGDNRKTVVSVDASELEKHVLAVDDSSVDRAVIARILRGSRYKVTAVESATRALELLALGLLPDVSMIITDYWMPGMTGYELLKRVKESAALRGIPVVIMSSENVSTRITRYLEEGAEGFLLKPVRPADVSRLCSRIR

SEQ ID NO: 67557 - protein, 376 aa, Halobacterium sp. NRC-1
MSDELKKGLEDVLVAESDLSFIDGDAGKLVYCGYAIEDLARTASYEEVLYLLWHGDLPTRSELDAFRADMASHREIDDDVLALVENLAAADADPMAALRTAASALSAHDDTAGGSDPDDARESGKRITAKLPTIVAAFTRLRNGDDVVAPRDDLGHAANFLYMLNGEAPDDVLADVFDQALVLHADHGLNASTFSGMVTASTLADVHAAVTSAIGTLSGSLHGGANANVMRMLKEVDDSDKDPLSWVQDALANGERVMGFGHRVYNVKDPRAHILSERSEELGAAAGDTKWYEMSVAIEDYMADEKGLAPNVDFYSASTYYQMGIPVDIYTPIFAMSRVGGWVGHVLEQYDDNRLIRPRARYVGAEDRDSTPLDER

SEQ ID NO: 67558 - protein, 204 aa, Triticum aestivum
THASDDLSDSDDDDTSSRASDASSDFSTPPPASASKAARAATPASVVDDIDHHLRNLQLKYSEPISPNPSPAPNPGASASASAVNAVKLYLHIGGSTAAARWVNSDRLAAVSFVRSGEGASDPDEDDEPTGPWFLVVGSKIRAKVGPELQLKTFPVQRRVDFVADGVWALKFLHADGYGDFNAKYQSCLFENSYGVEATDEGRA

SEQ ID NO: 67559 - protein, 519 aa, Medicago truncatula
MASSESNSQMKVVHGDAGYILEDVPHLSDYVPNLPTYPNPLRSNPAYSVVKQYFVHMDDTVPQKVVVHKDGPRGVHFRRAGPRQKVYFRSDDVIACIVTCGGLCPGLNTVIREIVCGLSYMYGVDKVLGIDGGYRGFYSKNTITLTPKVVNDIHKRGGTILGTSRGGHDTGKIVDSIQDRGINQVYIIGGDGTQRGAAVIYEEVRRRGLKVAIAGIPKTIDNDIPVIDRSFGFDTAVEEAQRAINAAHVEAESVENGIGVVKLMGRYSGFIAMHATLASRDVDCCLIPESPFYLEGKGGLYEFITKRLKESGHMVIVIAEGAGQDLLTESMQDMDQKDASGNKLLQDVGLWISHKIKDHFAKENKMAIVLKYIDPTYMIRAIPSNASDSVYCTLLAQSAVHGAMAGYTGFTAGLVNGRHTYIPFNRITEKMNNVVITDRMWARMLSSTNQPSFLKPKDVHQIMKAGQSPTQLLEGSNCNGGGEEAKKVEQIPTQLMEGDKSKDNQKSRNLADSDSCIKK

SEQ ID NO: 67560 - protein, 250 aa, Methylococcus capsulatus str. Bath
MRRPLVVGNWKMNGRSASVARLLNDILAGIGDCKAEVGVCVPFVYIPQASEILKGTKVMLGAQNVADHNSGAFTGEISAGMLREFGCELAIVGHSERRLLYGESNELVASRYEQAIQGHLKPILCVGETLEQREQGRTLAVIGAQIDTVFEFAGVQSLEHAVIAYEPVWAVGTGRSATTGQAQEVHYHIRSLIARWNPEVAQAVQIIYGGSVKPENSAELFAMPDIDGGLIGGASLDARAFLSICHSVSV

SEQ ID NO: 67561 - protein, 647 aa, 'Chlorella' ellipsoidea
  misc_feature (613)..(613): Xaa can be any naturally occurring amino acid
  unsure (1)..(647): unsure at all Xaa locations
MAAFLNSHLLAGWRPVLPVPARPHVHASASNGNGVATAPLPTITDIYGTTAALGPDMNAAGAYSMPAKEAEPVSPEVQALIDEQGIDFELSGLKYLSNEGRLKALAKKATKVEKMKNKKSGDRIWSDISELAALVRSGEKTWEELNLDDVDVRTKWAGLFHRKKRAPGTFMMRLKVPNGEITSKQLRVLGEQLKPFGDELGVGDITSRANFQLRGIPMAETDNVIKAVQGCGLSNVMTGMDNVRNMTGSPIAGIDPHELLDIRPLNYEINNMITNYGKGNHELSNLPRKINLALSPSRDDFPHVFINDVGLQAIRHPETGEVGFNVELGGYFSIKRNTQSINGNTYLRQDQVVAYCKALLEFFRDAGNREDRQKAGLMWLVEACGVDNFRKNVAQRMGLDDLPGHVHVEYPDVWKRRDVIGFHPQKQDGYYWACACVPSGRITADDYLAFAEIADRYGNGTARATVECNILFPFIPESKLEDLKKEPLFQKFSLEPKPLTRGLVSCTGAQFCGVAIIETKQRAMAIAAKLENELDIPQTVRMHWTGCPNSCGQVQVADIGLMGGPARHEGKAVEGVRIFTGGKVGEGASLGAEIEKGVACNDEVLLPKLREIXINQYGRHREEDGSLQDGDWRAGRPRLGPSRMTVL

SEQ ID NO: 67562 - protein, 382 aa, Thermus thermophilus
  misc_feature (234)..(234): Xaa can be any naturally occurring amino acid
  unsure (1)..(382): unsure at all Xaa locations
MRGLSRRVQAMKPSATVAVNAKALELRRQGVDLVALTAGEPDFDTPEHVKEAARRALAQGKTKYAPPAGIPELREALAEKFRRENGLSVTPEETIVTVGGKQALFNLFQAILDPGDEVIVLSPYWVSYPEMVRFAGGVVVEVETLPEEGFVPDPERVRRAITPRTKALVVNSPNNPTGAVYPKEVLEALARLAVEHDFYLVSDEIYEHLLYEGEHFSPGRVAPEHTLTVNGAAXAFAMTGWRIGYACGPKEVIKAMASVSSQSTTSPDTIAQWATLEALTNQEASRAFVEMAREAYRRRRDLLLEGLTALGLKAVRPSGAFYVLMDTSPIAPDEVRAAERLLEAGVAVVPGTDFAAFGHVRLSYATSEENLRKALERFARVL

SEQ ID NO: 67563 - protein, 1117 aa, Adiantum capillus-veneris
MSSTRHSYSSGGSGKSKHGRRIAQTSANAKLYAAYEESSESGSFDYSQSVSAGKEGISSQLVTAYLQRMQRGGLVQQFGCLIAVEEETFRVLHMCEAPEMLDVATQAVPTMGQYSRLCIGADVRTLLSPASASALDRVIGVVDVSMFNPITVQSRSSGKPFYAILHRNDVGLVIDLEPIRPDDASITGGALQSHKLAAKAIARLQSLPGGDIGLLCDSVVEEVHELTGFDRVMAYKFHEDEHGEVVAEIRRTDLEPYIGLHYPATDIPQAARFLFMKNRVRMICDCRLPPVKLIQDKTLSQPMSLTGSTLRAPHGCHTQYMANMNSISSLVMAVIVNDSDDDSAGHSSQGIKLWGLVVCHHTSPRYVPFPVRSACEFLMQVFSLQLNMEVGMAAQVREKHILRTQTLLCDMLLRDAPIGIVSQSPNIMDLVTCDGAALYYGKKCWLLGTTPTEAQIVDIAAWLLDCHKDSTGLSTDSLAKTGYPEASCLGDAVCGLAAAKITATDFLFWFRSHTAKEVRWGGARHDPEERDDGRRMHPRSSFKAFLEVVKQQSLPWEDVEMDAIHSLQLILRGSFQDIDDSNTKTMIHARLNDLKLQGLDELSTVASEMVRLIETATAPILAVDGQGLINGWNGKVAELTGLSFETAMGKSLAKELVHEESKTIVERVLHLALEGEEEQDIEIHLRTYDQHKQKGVVILIVNTCCSRDVSNNVVGVCFVGQDVTGQKLVLDRFIRIQGDYKAIVQSLNPLIPPIFGADEYGFCSEWNAAMEKLSNWRREEVLGKMLVGEIFGLQMVCCRLQGQDVVTKLMIVLNDAVNGQESEKFPLVFYDRNGRRVEALLIASKRTDADGRITGVFCFLHTASPELLQALIIKRAKEKVDKELSYVKEELKKPLEGLAFTRTVLEGTNLTIEQRQLIKTNAWCERQLRKILEDDLNNIEEGYMDLEMSEFFMGSVIDAVISQGMAASRGKGVQILTEIPNDVKLMCLFGDQARLQQVLADLLFCAINHATTTNEDEKDWVTIKVSRTKTRLDDGVHLMHFESRISHSGQGISEALVEEMTNKSQKWTPEGLAISISCTLIRLMNGDVKYTTDAGNKCFLVTIQFPLAHRDDATSVR

SEQ ID NO: 67564 - protein, 394 aa, Roseovarius nubinhibens ISM
MAWKTLDDMDLAGKRVLTRVDINVPVENGKVTDATRIERIAPTVEHILSQGGIPVLIAHFGRPKGKVVLDMSLRIVLPALEAALGHKVGFVETLEGAENLTGEARAAEVLLLENIRFYPGEEANDPEFAARLAGLGDIYCNDAFSAAHRAHASTAGVAEHLPSCAGRLMQAELQALEAALGAPERPVVAVVGGAKVSTKLDLLGNLVDKVDHLVIGGGMANTFLAAQGLNVGASLCEHDMADTARQIMVKAGAAGCEILLPADVVVAREFAAGAENEVVPAHACPEDAMILDAGPQSVARVAAVLAKAKTLIWNGPLGAFEIAPFDTATNAAAQEAARLSREAGLISVAGGGDTVAALNQAGAAEDFTYISTAGGAFLEWMEGKTLPGVAALGG

SEQ ID NO: 67565 - protein, 354 aa, Glycine max
MSPSNGLHNGGGGGSGGGGGNGVSYIEHQVSKLDTLAGVAIKYGVEVADIKRMNGLATDLQMFALKTLKIPLPGRHPPSPAPGPHDEPAKSGEASIERKPLRIGQSAMKEPLQSLELKPPQPNISPAMSILQKFYGLKSSNSRDTLNGTEMAVYLSSNSDHSSGEWLPKASPILDLPSASNDYPRSTNLVYDLLTGDDEYVPLAEIGDTGVEKSDEKSVRRRQKAEVDNGTSTPEKIMKEGNGNGSNGLSSNGKTLAMRPKSASRAALFPESESGWLDSIPVGLGESIFTDGFSGVRKSSSASSLREQEKNNSAAAWPPAIWSLKPDLQAAISKPIFDGLPIPISGRRSKAALD

SEQ ID NO: 67566 - protein, 323 aa, Arabidopsis thaliana
MAALSEKEAEAYLDARPRYPIDWFKKIAARTQDHKFAWDVGTGNGQAAIGLVEHYENVVATDINEAQLQRAIKHSRISYHHTPTTISEDEMVDLLGGENSVDLIVAAQAVHFFDLNVFYNVAKRVLRKEGGLIAVWVYNDIIISHEIDPIMKRLVDSTLPFRTPIMNLAFDGYKTLTFPFETIGMGSEGKPITLDIPHKLSLKGFIGFLRSWQPAMKAKEKGVELINEDLITKFEEAWGDETQVKDVFYKAHMIVGKIPEEKFESDQVLSNKGRLLLETEVGRNQKRPQPSDEGDRQSKKQNTSEDDACKDKPSSVFSTHYRF

SEQ ID NO: 67567 - protein, 1679 aa, Aspergillus nidulans FGSC A4
MSELWYQRPAAGWDEALPVGNGRLGAMVYGRTDTELLQLNEDSVWYGGPQNRLPEDALKCLPRLRELIREGAHKEAERLARRAFFASPNSQRHYEPLGTLFLEFGHPCEEVTGYRRSLDLNEGITHVHYEHNGVQYHRQVIASYPDNVLAMRVQASRCSEFLVRLSRLSELEYETNEFLDDLVVDGQSIKMHVTPGGKDSNRACCMVAIRCGSDDQEPIKVDCVGKNLIINARDALIVIVAQSTYRCDDADLDRATVADLEAVLASSVEDIWARHITDYQSLYGRLELNLGPDATDIPTDQRILHVRGPELVAIYLRYSRYLLISCSRPGRKGSSDRVLPATLQGIWNASFHPPWGCRYTININLQMNYWPANVGNLLECEEPLFALLERLAVTGTETARKMYGCRGWTVHHNTDLWADTAPVDRWMPATLWPLGGAWLCTHVWERFLFNGNKAFLKRMFPVLRGCVEFLQDFLVDDVSGQYKVTNPSLSPENTFRDEKGQEGVLCEGSTIDIQLVRAVLKAFVESLEVLGYSQDELLPSVHDTLRRLPPARIGSKGQLQEWMFDYDENEPGHRHVSHLWALYPGNDINLETTPELAKACAVTLQRRQAAGGGHTGWSRAWLLNLHARLRDADECAEHLERLLAQSTLPNLLDTHPPFQIDGNFGGGAGILEMLVQSHEDGIIRLLPACPLAWRSGRLRGVRARGGFELEFEWKDGVIRGPEASAFFYTSHSRCEDSTTYGKHNALGISTIMDLTSVQDLKGALRNDFFHGYATAAAQVEGAWNKDGKGPSIWDTFGHTPGKVKDNSNADDAVRFYDFYREDVALMKSYGVNAYRFSLSWSRIIPLGGADDPVNEQGIKYYQDLVDELLNNGITPFVTLFHWDVPQALEDRYGGMLNQERFIPDFVRYARVCFERLGPKVRHWITFNEPGVYSLAGYAAGVHAPARSSFRELNEEGDSSTEPFIVGHTELVTHGHVSKLYREVFQPQQKGTIGITLHGNWSEPWDEDDPRDQEAAERAREFEIAWFADPLYKTGDYPASMRAQLGDRLPRFTPEESKLVLGSSEFYGMNSYTTFFVQHKDTPPDINDHKGNVIVHDTNSKGVSRGEESDTPWLRTAPTGWRKLLNWIWNRYHVPIYVTENGTTAKGETAPTPEVLIDTFRMRFFEGYVGGLARAVKEDGVDIRSYFAWTFTDNWDRKGPIQMVEIFRRSYASTVRPATAPRPSPNVKHVRENAELYAQNCRDRNYPAHAEYPFKIQQLSEELRQIDKQLMPFRSRIKALERTIGRLQNPATGPEEKEQEPAIRAEAQQLKNESAALITRRELCDEQIHDLALSLPNLTSPHTPVGLEPALVEYLNFDPQSPPAWVSSPDPLRSHVSIGTDLGLIDFTSAATTTGWGWYFLTGDGALLEQALIQYSLSVARRHGWTPISPPSIVWSYLTEACGFQPRDQNNEQQIWAIEQAEKDKAKPPRSLAATAEIPLAAMHARNELDPAALPIKLVGPSRCYRAEAGSRGVDTKGLYRVHEFTKVEMFGWADSSPTSSSPTSDDLFEGLLTVQKEILTSLQLPCRILEMPTSDLGASATRKRDIEALFPSRMRGNGLEDAWGEVTSASICTDYQSRRLGTRVRGVKSVFPHTVNGTAVAVPRVLAAILENGWDAERKVVVLPEVLRPFMGGAEVIGK

SEQ ID NO: 67568 - protein, 589 aa, Brassica napus
MSLPETKTQTLLDAWDFQGRPADRSKTGGWASAAMILCIEAVERLTTLGIGVNLVTYLTGTMHLGNATAANTVTNFLGTSFMLCLLGGFIADTFLGRYLTIAIFAAIQATGVSILTLSTIIPGLRPPRCDPTTSSHCVQANGIQLTVLYLALYLTALGTGGVKASVSGFGSDQFDDTEPKERSQMTYFFNRFFFCINVGSLMAVTVLVYIQDDVGRKWGYGICALAIVLSLSIFLAGTNRYRFKKLIGSPMTQVGTVLVAAWRNRRLELPSDPSFLYDLDDVIAAEGSMKSKQKLPHTNQFRSLDKAAIKDQEMAMTQNVYNKWTLSTVTDIEEVKQIVRMLPIWATCILFWTVHAQLTTLSVAQSETMDRHIGSFEIPPAAMAVFYIGGLLLTTAVYDRLAIPLCKKLFNYPHGLRPLQRIGLGLLLAAMGMAVAALVEIKRLRTAHAHGPTVKTLPLGFSLLIPQYLIVGIGEALIYTGQLDFFLRECPKGMKTMSTGLLLSTLALGFFFSSVLVTIVEKVTDKAHPWIADDLNKGRLYNFYWLVAVIVALNFLVFLVFSKWYVYKEKRLADLGIELEDEPDIPMGH

SEQ ID NO: 67569 - protein, 70 aa, Triticum aestivum
AATTSLMAGVSTLTSMSAILGEMLGSGRATPRLLQLYAPYVVFAVIAILRGLCSCSAPPSPASSARKKRV

SEQ ID NO: 67570 - protein, 638 aa, Streptomyces verticillus
MRPVCGIVAIRSADGGLDGGELTAPMADLRPRGPDGEGTWVSPTGRAALGHTRLAVIAPDAGRQPVAGPDGTVRLVVNGEFYGYREIRAELRAAGCRFRTGSDSEIALHLYLRDGRRALERLRGEFAFVLWDERRATLFAARDRFGVKPLYYTERDGRLYVASTVRALLSCGAPARWDTAAFAAHLQLGLPPDRTLFAGIRQLPPGCHLIADAHGTRVTPYWDLDYPPAGELAARGSLDDHLDAVRERTDEAVRLRTVADVPLACHLSGGLDSSAVAASAARHTRLTAFTVRFDDPAFDESAVARRTAAHLAIDHREVASERAHFADHLRDVVRAGEMVQENSHGIARYLHSAHIKKAGFTAVLAGEGGDELFLGYPQFRKDLTLSLSADARDKADRGYARLVAAGLLPPYLRTLLGTLGFLPSWIVDRHLAVTQPVAALLRPDFAAELARADAAAPLLAAGAGLLAGRAPAHQATYLFAKTWLPGYLLAAERLDAAQAVEVRLPLFDHHLFDLVRHTPPAWYDKDGTGKYPLRAAMRHRLPREVTEGRKQGFLAPPMADDDTLLDALRERLAGPGAGDDPFFDPHAVRALLDRLAAAPPGQRSGGEKLLQLVASTAELADEFGLTTAPSGQKGGNGG

SEQ ID NO: 67571 - protein, 245 aa, Myxococcus xanthus DK 1622
MDSLILDSNTWLLVLTGAGVSAESGVPTFRGMSGLWEDQPVEAVASPEGFRKDPALVWRFYSERRKAAAAVHPNPGHEALVAWERHLGDRFLLATQNVDGLHTRAGSQRVVEMHGNLFKTRCSRCGRPPFEDATVYPAGAVPECDACGKLLRPHIVWFGEYLDPADIQRIEDFSLRAATSGGRFVFLAAGTSGAVYPAAGIVDQVRKAGGKTWLVNLDPAENSNRFEHRIVDKSGEVLPTLAKLA

SEQ ID NO: 67572 - protein, 237 aa, Zea mays
  misc_feature (86)..(86): Xaa can be any naturally occurring amino acid
  misc_feature (138)..(138): Xaa can be any naturally occurring amino acid
  unsure (1)..(237): unsure at all Xaa locations
MTMKSSSGGGHVIGVPVTSKAHGIEEVSRDPSFGKGAGDHLAVSLTHPSPYASFGYKHTGSKGQVTHWVSKLSRRAQGFREHVTLXGPKLSETVKGKLSLGARILQAGGVERVFRQAFSAADKGERLLKALQCYIYTXTGGPIAGMLFVSTRKVAFRSDRPITVTSPGGGGDTARVTYKVAIPLRRIRRVRPSENVHRPEEKYIHVSTVDGFEFWFMGFVSYQRSCKYMQQAVSEMR

SEQ ID NO: 67573 - protein, 198 aa, Brassica napus
LRMQKGLVPTKFFADMLRIAKILKASPSCVANLEKRIGMQLDQAALEDLVMPSFSHTMETLYDVDSVQRILDHFLSTDQIMPADVGSPCSSVDDGNVIGSPRLITPMTAVAKLIDGYLAEVAPDVNLKLPKFQALAASVPEYARLLDDGLYRAIDIYLKHHPWLAETERENLCRLLDCQKLSLEACTHAAQNERLPLR

SEQ ID NO: 67574 - protein, 429 aa, Arabidopsis thaliana
MVNPEENNRNLVVKPITEILQDDDKRSRKFGVEMKRQNRRALGVINHNLVGAKAYPCVVNKRRGLSQRKQESCDKKKLDSLHPSISRSQEETKKLKPSGNEFGDCIFIDEEEEKNEEVTLDQPMPMSLEEPYIEFDPMEEEVEMEDMEEEQEEPVLDIDEYDANNSLAAVEYVQDLYDFYRKTERFSCVPLDYMAQQFDISDKMRAILIDWLIEVHDKFELMNETLFLTVNLIDRFLSKQAVARKKLQLVGLVALLLACKYEEVSVPIVEDLVVISDKAYTRTDVLEMEKIMLSTLQFNMSLPTQYPFLKRFLKAAQSDKKLEILASFLIELALVDYEMVRYPPSLLAATAVYTAQCTIHGFSEWNSTCEFHCHYSENQLLECCRRMVRLHQKAGTDKLTGVHRKYSSSKFGYIATKYEAAHFLVSDSH

SEQ ID NO: 67575 - protein, 432 aa, Gloeobacter violaceus PCC 7421
MVTSAFQTAQSHRLFAEAQQLMPGGVNSPVRAFKSVGSEPVFIERAEGAYLWDVDGNRYIEYINTWGPSIVGHSHPEVISALREALPKGTSYGAPTRLENQMARTVIDAIPAVEMVRFVNSGTEATMSALRLARAFTGREKIIKFEGCYHGHADMLLVQAGSGVATLGLPDSPGVPKSTTAATLTAPYNDLAAVEALFKQYPSDVAGLILEPVVGNAGCLVPEIGFLEGLRDLTHAHGTVLIFDEVMTGFRLSYGGAQARYGIEPDLTCLGKIIGGGLPVGAYAGRREIMQMVAPAGPMYQAGTLSGNPLAMTAGIKTLEILQRPGTYERLEGLSARLADGLLAAAREAGHAATGNRVGAMFTLFFTEGPVRNFADAKRSDLQKFARFHRGMLERGVYLAPSQFEAGFMSLAHTEEDIDYTVAAARTVLAAL

SEQ ID NO: 67576 - protein, 319 aa, Klebsiella pneumoniae
MLSKQALLQAYRKMREIRTFEERLHQENTSGDIPGFIHLYTGEEAIAVGVCENLTSADFIGSTHRGHGHCIAKGCDIHGMMAEIFGKDSGLCRGKGGSMHIADLSKGMLGANAIVGGAPPLAIGAALTAKTLKTGNVGVSFTGDGGSNQGLVFEAINMAVVLQLPAVFIFENNGYGEGTGHDYAVGGRDIARRAAGFGLPAVTVDGTDFFAVYEATSEAVKRAREGGGPSVIEAKAFRWHGHFEGDPALYRAEGEVQRLREQHDPLKIFTAKVKQHITQEELAAIDEEVEALVNDAVLKARAAAYPAPEDLLTDVYVSY

SEQ ID NO: 67577 - protein, 339 aa, Klebsiella pneumoniae
MTIKTYREAVKEALAQEMERDERVVLIGEDLRGGHGGNAPEEAKIEAFGGVLGVTKGLWTQFGSDRVIDTPITESAIIGMAAGAAATGLRPVAELMFMDFFGVSHDALYNQAAKFRYMFGGKARAPLVMRGMIGAGFSAAAQHSQSPYNIFATTPGLKVVVPSTPYDVKGLLIQSIRDDDPVVFCEHKMLYDLKGEVPDEIYTIPLGVANYTREGEDVTIIALSAMVHKANQVADKLAREGISVEVVDPRTISPLDEEGILESVASTGRVVIVDESAARFGFAHDVAALIASQAFHFLKAPVLLVTPPHTPVPFSPALEKLWIPGVERIEAAVRQVLED

SEQ ID NO: 67578 - protein, 291 aa, Methylococcus capsulatus str. Bath
MIQGSIVALATPMEPDGRLDVPGLRRLVEFHIEQGTDAIVAVGTTGESATLDEEEHTEVIRLVVEQAAGRIPVIAGTGANATTEAIRLTARAKAVGADACLLVTPYYNKPTQEGLYRHYLAVAEAVDIPQILYNVPGRTGCDMLPATVGRLAQVPGIVGIKEATGKLERLAEIRALCPEGFALYSGDDATACEFCLSGGNGVISVTANVAPRLMQEMCRAAIAGDRATAEAINRRLEALHHDLFIESNPIPVKWALHEMGLIQEGIRLPLTWLAASCREAVRQAMRQAGVL

SEQ ID NO: 67579 - protein, 391 aa, Pseudomonas viridiflava
MEQQCDVAVLGLGAMGAATLYQLAREGADVLGIDQYAPPHTQGSSHGDTRITRLSVGEGPQYLPLVRNSHRIWRELEAMTGEPLFEQCGVLVMTSSPAYDPQDPEDFTHKTIALAREYGVRHEVLSAEDIRERFPQFSPVLDTAIGYFEPDGGFVRPERCIAVQLQLAGKLGARIRLNETVTRLQAHGDQVRVTTDQGSIIANKVVVSAGMWSSHLLGEPFTDLLRVCRQQLFWFALEDTVAFAPVSPSFILTHGPREVDINYGFPPLPGEGSMKIATEQYLHASQARELDRSVSAEDERTMFQTQVSGKFAGIKADVVKSSVCAYTVTPDYHFIIDDHPHLKNVTVVSACSGHGFKHSAGLGLALAQRCLRGTSEVDLSAFSLKRFGKTA

SEQ ID NO: 67580 - protein, 117 aa, Clostridium perfringens SM101
MHNERNHKSNRKEQIREDLTQFNIGDTIKVHVRIKEGNRERIQVFEGTVIKKQNGGLRETFTVRRVAYGVGVERTFPINAPIIDKIDVVRRGKVRRAKLFYLRDRVGKAAKVKELTR

SEQ ID NO: 67581 - protein, 339 aa, Haemophilus influenzae R2846
MAIKIGINGFGRIGRIVFRAAQHRDDIEVVGINDLIDVEYMAYMLKYDSTHGRFDGTVEVKDGNLVVNGKTIRVTAERDPANLNWGAIGVDIAVEATGLFLTDETARKHITAGAKKVVLTGPSKDATPMFVRGVNFNAYAGQDIVSNASCTTNCLAPLARVVHETFGIKDGLMTTVHATTATQKTVDGPSAKDWRGGRGASQNIIPSSTGAAKAVGKVLPALNGKLTGMAFRVPTPNVSVVDLTVNLEKPASYDAIKQAIKDAAEGKTFNGELKGVLGYTEDAVVSTDFNGCALTSVFDAEAGIALTDSFVKLVSWYDNETGYSNKVLDLVAHIYNYKG

SEQ ID NO: 67582 - protein, 188 aa, Haemophilus influenzae R2846
MAGTSAAMLGFAPANVLAAPREYKLLRAFESRNTCTYCAVSCGMLLYSTGKPYNSLSSHTGTNTRSKLFHIEGDPDHPVSRGALCPKGAGALDYVNSESRSLYPQYRAPGSDKWERISWKDAIKRIARLMKDDRDANFVEKDASGKTVNRWATTGIMTASAMSNEAALLTQKWIRMLGMVPVCNQANT

SEQ ID NO: 67583 - protein, 808 aa, Haemophilus influenzae R2846
MTNNWVDIKNANLIIVQGGNPAEAHPVGFRWAIEAKKNGAKIIVIDPRFNRTASVADLHAPIRSGSDITFLMGVIRYLLETNQIQHEYVKHYTNASFLIDEGFKFEDGLFVGYNEEKRNYDKSKWNYQFDENGHAKRDMTLQHPRCVINILKEHVSRYTPEMVERITGVKQKLFLQICEEIGKTSVPNKTMTHLYALGFTEHSIGTQNIRSMAIIQLLLGNMGMPGGGINALRGHSNVQGTTDMGLLPMSLPGYMRLPNDKDTSYDQYINAITPKDIVPNQVNYYRHTSKFFVSMMKTFYGDNATKENGWGFDFLPKADRLYDPITHVKLMNEGKLHGWILQGFNVLNALPNKNKTLSSMSKLKYLVVMDPLQTESSEFWRNFGESNDVNPAEIQTEVFRLPTTCFAEEDGSIVNSGRWAQWHWKGCDQPGEALPDVDILSMLREEMHELYKKEGGQGIKSFEAMTWNYAQPHSPSAVELAKELNGYALEDLYDPNGNLMYKKGQLLNGFAHLRDDGTTTSGNWLYVGQWTEKGNQTANRDNSDPSGLGCTIGWGFAWPANRRVLYSRASLDINGNPWDKNRQLIKWNGKNWNWFDIADYGTQPPGSDTGPFIMSAEGVGRLFAVDKIANGPMPEHYEPVESPIDTNPFHPNVVTDPTLRIYKEDREFIGSNKEYPFVATTYRLTEHFHSWTAQSALNIVAQPQQFVEIGEKLAAEKGIQKGDMVKITSRRGYIKAVAVVTKRLKDLEIDGRVVHHIGLPIHWNMKALNGKGNRGFSTNTLTPSWGEAITQTPEYKTFLVNIEKVGEA

SEQ ID NO: 67584 - protein, 257 aa, Coprinopsis cinerea okayama7#130
MLHTASLLHDDVIDESALRRGAASAPSAFGNKQSVLGGNFVLGRASAALSRLGDPEVTQLIAGVLSNLVEGEILQLKEIQLDGSPETASQRRQDAWNIYLHKTYLKTASLMAKGARSAVVLGGCKEGEIWKEIAYAYGRNLGIAFQLVDDVLDYESASATLGKPGGADLELGLATGPALYAWEEYPEIGELICRKFEQPGDVERARDLVLRSSGVERTKALAQEYASKAREVLQEIPDSDAKAALEVLTERVVGRRS

SEQ ID NO: 67585 - protein, 399 aa, Rickettsia akari str. Hartford
MSIISTRLNSIKPSPTLAVVKKTLELKKSGIDIIALGAGEPDFDTPDNIKEAAIKAIQDGFTKYTNVEGMPLLKQAIKDKFKRENSIDYELDEIIVSTGGKQVIYNLFMASLDKGHEVIIPAPYWVSYPDIVALSTGTPVFVNCGIEHNFKLSAEALERSITDKTKWLIINSPSNPTGASYNFEELENIAKVLRKYPHVNVMSDDIYEHIIFDDFKFYTLAQIAPDLKERIFTVNGVSKAYSMTGWRIGYGVGSKTLIKAMTIIQSQSTSNPCSISQMAAIEALNGPQDYIKPNALNFQKKRDFALSILKRVKYFECYKPEGAFYLFVKCDKILGHKTRSGKIISNSNDFAEYLLEEAKVAVVPGIAFGLEGYFRISYSTSMEEIEEACMRIERACNAL

SEQ ID NO: 67586 - protein, 363 aa, Roseovarius nubinhibens ISM
MSDTTTILGIESSCDDTAAAIVRVGGAVPEILSSVVDGQTELHDAYGGVVPEIAARAHAEKVDLCVRAALDTAGIGLGQVDAVAVTAGPGLIGGVMSGVMCAKGIAAGAGLPLIGVNHLAGHALTPRLTDAVEYPYLMLLVSGGHCQFLLVEGAEEFTRLGGTIDDAPGEAFDKVARLLALPQPGGPSVEAEAALGDAARFKLPRPLLDRPGCDMSFSGLKTAVLRARDGEMQEGRLSRRVRADICAGFQASVCDVLGEKTRRALEIYLEQAPARPVLAVAGGVAANGPIRARLMQVAEAAGAAFVAPPLRLCTDNAAMIAYAGAERFARGHRDGMDLAARPRWPLDKASPAMLGSGKKGAKA

SEQ ID NO: 67587 - protein, 352 aa, Glycine max
  misc_feature (93)..(93): Xaa can be any naturally occurring amino acid
  unsure (1)..(352): unsure at all Xaa locations
MSNLPTTQGKAIPDASDYKGRPAERSKTGGWTASAMILGGEVMERLTTLGIAVNLVTYLTGTMHLGNAASANVVTNFLGTSFMLCLFIGFFVXSFLHRYRTIAIFAAVQATGVTILTISTIIPSLHPPKCNGDTVPPCVRANEKQLTVLYLALYVTALGTGGLKSSVSGFGSDQFDDSDDDEKKQMIKFFNWFYFFVSIGSLAATTVLVYVQDNIGRGWGYGICAGAIVVALLVFLSGTRKYRFKKLVGSPLTQFAEVFVAALRKRNMELPSDSSLLFNDYDPKKQTLPHSKQFRFLDKAAIMDSSECGGGMKRKWYLCTLTDVEEVKMILRMLPIWATTIMFWTIHAQMTT

SEQ ID NO: 67588 - protein, 350 aa, Cryptococcus neoformans var. neoformans JEC21
MPSSLDNTRRHVQVFAERVGAVAGSEFPGHYPGEDHSWNLQKFKQDLVASVQRLTPSTIEFDLVGVDASIANALRRTLIAEVPTVAIEEVYVWNNTSIMQDEVLCHRVGLVPLKIDPRSLRYRPSANSQPHEHDTVVFDLRVRCDRRPNVDRSETDPKKMYFDSNVYSGMLKWVPSGDQKKKFKGKAPRPVNDDILLVKLRPGQQVDLHCFARKGVGADHAKFSPVATASYRLLPHIILRGPIPKEHQQKFKGCFPPGVIEIEKDENGEDQCVVKNPRKDTVSREVLRHPEFQDLVQLARIRDHFIFNVESAGQYSPEELVPEAIKILLGKIKDVEEGLDKLFATEGQAA

SEQ ID NO: 67589 - protein, 114 aa, Escherichia coli
AQQNILSVHILNQQTGKPAADVTVTLEKKADNGWLQLNTAKTDKDGRIKALWPEQTATTGDYRVVFKTGDYFKKQNLESFFPEIPVEFHINKVNEHYHVPLLLSQYGYSTYRGS

SEQ ID NO: 67590 - protein, 714 aa, Treponema denticola ATCC 35405
MMNMNDLSFFQGKASPLGAKLSCDGVNFSVFSRNAKEIVLHLFENVEDSEPIISYKLDPQINKTGDVWHVFVSGLKSWAFYLYTADGEFSPSAGFLFDENNYLLDPYARLISSHSVFNSEQTFNQKDSKASGGKNQHKRTAKGFPKCVVIDDREFDWQGDKPLNIPLQKCVIYEAHVKGFSFLNDKISPTKRGKYSGLVELIPYLKDLGITSLELLPVFDFDENENMNINPKTGVRLKNYWGYSTIAFFAPKALYAEDPGNAVNEFKFMVREFHKAGIEIILDVVFNHTAEGNENGPVFSFKGFDNSIYYHLEDNKFYYKNFSGCGNSLKTSEIPVIKFILDCLRYWVTEMHVDGFRFDLAPVLARDKTGSIDLNSFMIQAIADDSVLRSTKIIAEAWDAAGAYMVGKFPGRWAEWNDLFRNSVREFWLQPNPDIRHLATRVTGSADLYSQKGRRPYQSINFVCCHDGFTLCDLLSYSEKHNEENGENNRDGSNENLSYNHGIEGSASVEIERMRMRSAKNILTTLILSAGTPMINMGDEVFRTQNGNNNAYCQDNEMSWFDWELLNENKDLLEFTKKLINLRKTHFSFLRKHFFTGASKINGTPSDITWFDYNAQKPNWNVPSNFLAFLIDGNKINLESDEDDNDFYVMTNSYNNDITVRLPPPSSGGKIWHRLIDTSYTDGKDFLDEEHTEQIMNQQIYVVLSRTTVVLIAK

SEQ ID NO: 67591 - protein, 852 aa, Cryptococcus neoformans var. neoformans JEC21
MSTPPFLPLVTSQDTTLLPSLALITPVLIPSDHLEQIRQSLPANASYYVQANDNDDLIALLDGGAEKLVVTPQQLGAGGAGIPKERLILQVSEEELSTSKRFAQQTGGILIISCVPHNAKSLALPGVDVFLQLPEVQPLRILNLIRSSRPSSYVIPSSYLSIESSTTAEKISIPEAFLAPIISDRPDGLFPTIVSSYSHSTTPLGLVYSSIESVKESILTQKGVYQSRKHGLWRKGETSGAVQQVTGIKLDCDNDALIFEVVQHGSGFCHLPQSTCFGNLSGIAKLSDTLTSRLASAPEGSYTKRLFTDEKLLRSKIMEEAEELCDAQTKEEVAFEAADLVYFALTRCVSKGVSWRDVEAALDKKALKVTRRKGDAKPKWEEKTREVVNENGEAKPTVPEPTKLPETESEDVPIKMRAVTLSTLSVLEQKDLLLRPVLNSLAMIDKVKPIVERVRQEGDAGLKAMTKQFDRADLSSNVLLPPFETPGEDVLPKDVREAIDVAYNNVKEFHQAQNEKEPLVVETMPGVTCSRFARPIARVGVYVPGGTAILPSTAIMLGVPAQVAGCKTIVLATPPRQDGSISPEVLYVAKLTGVTCILKAGGAQAVGAMAYGTDEVPKVDKIFGPGNQWVTAAKMLVQNDTDALVAIDMPAGPSEVLVIADYTANPVFVASDLLSQAEHGVDSQVILLAINLTPEHLAAIEAEIDRQARALPRVKIAREAIKKSVTVEVKDLEEAVKFSNEYAPEHLILHLEKAEEVVAEIENAGSVFVGPFSPESCGDYASGTNHTLPTNGFARQFSGVNTLSFQKHITSQIVSAEGLKKLGPYVIRLAEREGLEAHANAVRVRLAELNKQ

SEQ ID NO: 67592 - protein, 397 aa, Rickettsia akari str. Hartford
MLSKLNKPALFALIFYPIFIISLVVKYSFNYGIGRTEVIFIIASYYINNITVGIGLHRLWSHNAYKINKCAEFVLIMLSAGTLQGPALSWASNHYKHHAKTDTDQDPHSPLKFDSKVLGFLWSHIGWMLVGSGSYKSIDRITWAKHGKNNLLKWQLKYYWQIAAFMNIVVPLFIGYLVDGTIQSAYAGFVFMGLGRFLQQQATFCVNSLCHFAGSKKYYKGTAGDIWWMALFLLGENWHNYHHAFPSDYRNGAKWYHLDVHKWIIFLMSKIGLASELERTTKVRIQAKMQETLSYLSEKQKQKLTLMQAKIDHLLENLCLKIKELEESSITIKGQFKKSFVEIQESLKILAEQISSATQITEKPSEKLLKIVNKKIIDAEQSIYRLYNQFNTLKVSS

SEQ ID NO: 67593 - protein, 674 aa, Bacillus anthracis str. Ames
MTQNINQLAVNTIRTLSIDAINAANSGHPGLPMGAAPMAYALWANHLNHNPNHPKWFNRDRFVLSAGHGSSLLYSLLHLAGYDVSIDDLKNFRKLNSKTPGHPEFGHTSGVEATTGPLGQGIANAVGMAMAEAHLAAKFNKDGHSIIDHNTYALVGDGDLMEGVAYEAMSMEGVAYEAMSMAGHMKLGKLIVLYDSNEISLDGELNIAFSEDMQKRVESAHWQYVRVEDGNDVDAITKAIQLAKDNTDQPTLIEIRTVIGYGSPKVAGTNKAHGNPLGLEEATATKQVYGWHYEEDFFVPEEVTAHFNELKQKGIEKERGWNEQFNLYRESNPALADELEKAIIGEVLIEAKDILSFDSEKTISTRVASGEAINHYVKSIPSIFGGSADLSHSTMTDIKGEAVYAVESYAGRNIYFGVREHAMGAAANGLALHGGVKPFVSTFFVFNDYLRPSIRLAALQKLPVTYVFTHDSIAVGEDGPTHEPIEHLAALRAIPGLTVIRPSDANETASAWAYALQQTEGPVVLVLSRQNLPVFHETKANIENLSKGAYVLTQTNENPDVILIATGSEVSLAASAKAKLEEDNVSVRIVAMPSWELFDRQSKEYKESVLPSSVTKRVSLEMGVSLGWERYVGQEGNILSIETFGASGTGAEVMNLFGFTTENVVQITKNVLNS

SEQ ID NO: 67594 - protein, 186 aa, Capsicum annuum
MMNANGFSGVEKEYIRKHHLHQPKENQCSSFLVKHIRAPVHLVWSLVRRFDQPQKYKPFVSRCIAQGDLEIGSLREVDVKSGLPATTSTERLELLDDEEHILSFRIIGGDHRLRNYSSIISLHPEVIDGRPGTLVIESFVVDVPQGNTKDETCYFVEALINCNLKSLADVSERLAVQDRTEPIDQV

SEQ ID NO: 67595 - protein, 189 aa, Brassica napus
MAMGSKRKTPPGILLLRRVRGRNWSPKTFRYAILLITFIAYACYHASRKPSSIVKSVLHPEPSTKPPQQEHINMRPWPLGNVFVKEEETDVLWRRGSANKGWEPFNGKGGTSRLGEIDVAFLACYSIGMYVAGHLGDSLDLRLFLTWGMIGTGFFVGLFGMGYFWNIHAFSVLSCDAMAAGLFQATGCR

SEQ ID NO: 67596 - protein, 440 aa, Triticum aestivum
MTMMAMPEAPCLCARPSLAARARRPGSGPAPRLRRWRPNATAGKGVGEVCAAVVEAATKVEDEGEEDEPVAEDRYALGGACRVLAGMPAPLGATALAGGVNFAVYSGGATAAALCLFTPEDLKADRVTEEVPLDPLMNRTGNVWHVFIEGELHNMLYGYRFDGTFAPHCGHYLDVSNVVVDPYAKAVISRGEYGVPARGNNCWPQMAGMIPLPYSTFDWEGDLPLRYPQKDLVIYEMHLRGFTKHDSSNVEHPGTFIGAVSKLDYLKELGVNCIELMPCHEFNELEYSTSSSKMNFWGYSTINFFSPMTRYTSGGIKNCGRDAINEFKTFVREAHKRGIEVILDVVFNHTAEGNENGPILSFRGVDNTTYYMLAPKGEFYNYSGCGNTFNCNHPVVRQFIVDCLRYWVTEMHVDGFRFDLASIMTRGSSLWDPVNVYGAP

SEQ ID NO: 67597 - protein, 103 aa, Glycine max
MSGRGKGGKGLGKGGAKRHRKVLRDNIQRITKPAIRRLARRGGVKRISGLIYEETRGVLKIFLENVIRDAVTYTEHARRKTVTAMDVVYALKRQGRTLYGFGG

SEQ ID NO: 67598 - protein, 110 aa, Saccharomyces cerevisiae
MSSQIIDRPKHELSRAELEELEEFEFKHGPMSLINDAMVTRTPVIISLRNNHKIIARVKAFDRHCNMVLENVKELWTEKKGKNVINRERFISKLFLRGDSVIVVLKTPVE

SEQ ID NO: 67599 - protein, 406 aa, Glycine max
MATLFQGLGVVNPSLASSNSNKFHLPSRTSLSERKDGIFVVRSDATRVSSQVLKAGARKHELLVTNAVATKEGRPAASTSKSGHELLLFEALREGLEEEMERDPCVCVMGEDVGHYGGSYKVTKGLATKFGDLRVLDTPIAENSFTGMGIGAAMTGLRPVVEGMNMGFLLLAFNQISNNCGMLHYTSGGQFKIPIVIRGPGGVGRQLGAEHSQRLESYFQSIPGIQMVACSTPYNAKGLMKAAIRSENPVILFEHVLLYNLKERIPDEEYVLSLEEAEMVRPGEHVTILTYSRMRYHVMQAAKTLVNKGYDPEVIDIRSLKPFDLHTIGNSVKKTHRVLIVEECMRTGGIGASLTAAITENFHDYLDAPIVCLSSQDVPTPYAGTLEEWTVVQPAQIVTAVEQLCK

SEQ ID NO: 67600 - protein, 427 aa, Rhodococcus erythropolis
MSIVIIGSGQAGFEAAVSLRSHGFSGTITLVGDEPGVPYQRPPLSKAYLHSDPDRESLALRPAQYFDDHRITLTCGKPVVRIDRDAQRVELIDATAIEYDHLILATGARNRLLPVPGANLPGVHYLRTAGEAESLTSSMASCSSLVVIGAGFIGLEVAAAARKKGLDVTVVEAMDRPMARALSSVMSGYFSTAHTEHGVHMRLSTGVKTINAADGRAAGVTTNSGDVIHADAVVVGIGVVPNIELAALTGLPVDNGIVVDEYLRTPDENISAIGDCAAYPIPGKAGLVRLESVQNAVDQARCLAAQLTGTSTHYRSVPWFWSEQYESKLQMAGLTAGADTHVVRGSVDSGVFSIFCFLGTRLLGVESVNKPRDHMAARKILATEMPLTPEQAADTDFDLKLAIARHKDTHKDEVASADIGERQVVAS

SEQ ID NO: 67601 - protein, 629 aa, Desulfovibrio desulfuricans G20
MCGIAGYCGACGVADTTEKECAGRLEALLAGIVHRGPDDAGITCAHNVAIGMRRLSIIDLAGGHQPMLSGDGRYALVFNGEIYNFRELRSELAEAGYSFATNSDSEVLLKGYMAWGRGVLDRLDGMFAFAVHDRHAGTVFLARDHLGIKPLYYIHLGGVFAFCSEPAPLLELPQVRRRLDHDALAAFLSFKYVPAPDTFIKDIKKLAAGHTLEYSPRGDMLRTERYWQLQGREGSSDAGELAERLTRAVDSQMVSDVPLGVFLSGGIDSGLLTWAAAGQGGEHFTGGYTVAFDETGRKKGLRAGGSFDESRLAALSAAHLGVPLSSTTLASPAQATLDDWIRRFQEPFANTSIPANFLLCQWVARHVKVALNGSGADELFGGYDRYYAVHPPAALRALHCAAPLLRRVADMLPVGGGKNSLVHRARRYLAGCALAPAQKHAGSIRLFTDTQLAAIAPGVVPATFVQDAFAGAPQGSLLYKATWTDMQTMLPDDYLTLVDRTSMAASLEVRVPFLARDFVQYAFSLPPAAKIAGWKKKTALRALAAKHLPEDIARQPKMGFESPVGRWFRDGLGEALCRQLAQSPLQNIISVRGVQALAQSHSAGQVDAAKPLLALYTLVRWMDMYRVEL

SEQ ID NO: 67602 - protein, 461 aa, Triticum aestivum
MGKAARWLRGLLGGGGKKEQGKEHRRPATSTAPHGDRKRWSFCKSTRDSAEAEAAAAAAALSGNAAIARAAEAAWLKSLYNETEREQSKHAIAVAAATAAAADAAVAAAQAAVEVVRLTSKGPTSTVLAVAVAEPRGRASAAVKIQTAFRGFLAKKALRALKGLVKLQALVRGYLVRKQAAATLQSMQALVRAQACIRAARSRAAALPTNLRVHPTPVRPRYSLQERYSTTEDSRSDHSVAPYYSRRLSASVESSSCHGYDRSPKIVEMDTGRPKSRSSSLRTTSPGASEECYAHSVSSPLMPCRALPRIAAPTARHFPEYEWCEKARPATAQSTPRYASYAPVTPTKSACGGYTYSNSPSTLNCPSYMSGTQSSVAKVRSQSAPKQRPEEGAVRKRVPLSEVIILQEGRASLSGGTQRSCNRPAQEEAFSFKKAVVSRFDRSSEAAERERDRDLFLQKGW

SEQ ID NO: 67603 - protein, 138 aa, Brassica napus
HASAQQTLNVSWDSQRNTLPKTSDNGRESSSASPIPTDVIVDIFSRLPLKSIAMCRCVSKLWASVLRLPHFTELFLTKSSSCPPQLLHARVTNSELFLFSSASPHPDENSSSPPVVASRHMKLSFGGFGEISCGRPVY

SEQ ID NO: 67604 - protein, 370 aa, Prunus armeniaca
TNEVPSIANYDRKSEVKTFDDTKEGVKGLVDAGITKVPRIFHLPVDQYPINNTCDSEPTKTQLRIPVIDLEGLEYDNSPTKRKETVAKVGEASETWGFFQIANHGIPVDVLEEIKNGVRGFFEQDTEVKKKYYTRDRFRPVIYNSNFDLYSAPATNWRDTFLCNMAPNPPKPEDLPQVCRDILVEYSKQVMKLGKLLFELLSEALGLKPSHLNDMDCSLGLQILGHYYPPCPQPELTLGTSKHADNDFITVLLQDHIGGLQVLHQNTWIDVLPVPGALVVNIGDLLQLISNDRFRSVEHRVLANRACPRVSVACFFSTGFLALPRIYGPIKELLSEDNLPKYRETTVKDYNAHHYNKGLDGTCALTHFKL

SEQ ID NO: 67605 - protein, 211 aa, Geobacter metallireducens GS-15
MITTLLEGNRRFVAETFEKEKELFVELTRGQKPTVLWIGCSDSRVPVNTITQTKAGEVFVHRNVGNIVAANDWNLSAVLEFSINHLKIPDIVICGHYGCGGIQALDEENSDDKYIPIWLINAYKAKERVDEKLRALHIDIPHEQRMKLIVEENVRLQLEHLREYPFVRRAVEEGKLTLNGWVYDMGNGEIRIVATESAPRIGKGTCSIKIK

SEQ ID NO: 67606 - protein, 444 aa, Gloeobacter violaceus PCC 7421
MPADIPSPNQMIAPLETRTDARGHLMIGGCDVVDLAQRFGTPLYILDEATLRAACTQYVEAFKRHYAGDFRVLYASKAWSNLAICAIVHRCGLGIDAVSAGEVHTALRAGVPGELVYLHGNNKSEAEILLAAEVGATVVADNWLDLEILSAISAECPVRVMVRVAPGIDIHTHEYIRTGHLDSKFGFDPSELAAVLAYLARIPSLRAVGLHAHIGSQSFELAPHGDAAQLLLEWYPKALALGLSDFNELNVGGGLGIRYTDDDDPPAIDEWVGTICQAVTRTCNTYNLPLPKLLCEPGRSLVGPACATAYTVGSTKTIPSIRKYFSVDGGMSDNPRPITYKALYTAVVANKMHDGRREKVTVAGKHCESGDVLLRDVELPPLERGDCLVVFSTGAYNCSMASNYNRIPRPAAVLVSDGEATLIVKRESPDDLLRCDCLPERLQT

SEQ ID NO: 67607 - protein, 419 aa, Magnaporthe grisea 70-15
MAPPAAITPVTPGTPEPSLNKGGPDTNLTAAAIGHKMSQASEYQELDASKLIYNLTTSPRALPDYDTAAAGSETVCTDHMVTANWHAATGWSAPTIKPYGPLSLMPTASVLHYATECFEGLKAYRGYDGKLRLFRPDRNANRMLMSSVRIALPSFPPEALEKLLIALMAVDGPKWLPRERPGTLLYLRPTMIGTQAQLGVQAPNQAMLFITASYFPTMDSPAGGMRLHTSPEDMVRAWVGGFGYAKVGANYGPSLLATKEAKSRGFHQILWLYGPEGYCTEAGASNFFVLMKNKQTGRLEIVTAPLDDRVILGGITRMSVLELARSRLGDEVDVVERRYTIDEVFEAYAEGRIVESFASGTAYFVCPISLIHHRGKEVSIPMGEDGQGGKYTLKLKQWLKDIMYGNEQHEWGVVVPEEQ

SEQ ID NO: 67608 - protein, 301 aa, Zea mays
METSKSPQSSKNSHIVVPSDSNGPRFDNDGFSSEAASNQMVVFNSEAGDKEQDELGENRLQKSIITRGISPSIGAFTVQCAKCFKWRLIPTKEKYEEIRERIIEEPFVCKRAREWRPDVTCNDPEDISQDGSRLWAIDKPNIAQPPRGWERQIRIRGEGGTKFADVYYTSPTGRKLRSLVEVDRFLQENPEYGAQGVTLAQFSFQIPRPLRQDYVKKKPKLINPSDEASMVASKSFQPEEVKPIAWAVATKHEGDASEEASLTDEAPTSEVMLARKRKAGSSLSVEPNHLSDELEPKLEDA

SEQ ID NO: 67609 - protein, 549 aa, Mannheimia succiniciproducens MBEL55E
MQNINPTSTAAWKALEAHKGTLENTTINDLFQQEKNRFADYSLTFNNEILVDFSKNKITRETLNLLRRLAKECALDEAKEAMFSGEKINRTENRAVLHTALRNRSNTAVLVDGKDVMPEVNEVLAKMKAFSERVISGEWKGYTGKAITDVVNIGIGGSDLGPYMVTEALRPYKNHLNMHFVSNVDGTHIAEVFKKTNPETTLFLVASKTFTTQETMTNAKSARDWFLATAKDEKHVAKHFAALSTNAAEVEKFGIDTDNMFGFWDWVGGRYSLWSAIGLSIILSVGFENFEALLSGAHEMDKHFRNTPIEQNIPATLALVGLWNTNFQGAQTEAILPYDQYMHRFAAYFQQGNMESNGKYVGRDGKVISNYQTGPIIWGEPGTNGQHAFYQLIHQGTTLIPCDFIAPAKTHNPLADHHNKLLSNFFAQTEALAFGKTKETVEAEFLKAGKSLDEVKDVVPFKVFAGNKPTNSILLQEITPFSLGALIAMYEHKIFVQGVIFNIFSFDQWGVELGKQLANRILPELSGDEQVTGHDSSTNGLINQFKAWR

SEQ ID NO: 67610 - protein, 728 aa, Oryza sativa (japonica cultivar-group)
MAAAAVRSVSPPTWEERPPVPSPPHKRKRAMGHAAHASPLERQVHILAHDAVQWHEPDMQPLVVVVVQIRKLGTRPSDLTVIFVHRKSGSSYPFQSTKTAPSLCALLMWVTKRLGITVLIVLFPLLIVHHLIVNSPVSGPSRYQVIHSNLLGWLSDSLGNSVAQNPDNTPVEVIPADASASNSSDSGNSSLEGFQWLNTWNHMKQLTNISDGLPHANEAIDNARTAWENLTISVHNSTSKQIKKERQCPYSIHRMNASKPDTGDFTIDIPCGLIVGSSVTIIGTPGSLSGNFRIDLVGTELPGGSGKPIVLHYDVRLTSDELTGGPVIVQNAFTASNGWGYEDRCPCSNCNNATQVDDLERCNSMVGREEKRAINSKQHLNAKKDEHPSTYFPFKQGHLAISTLRIGLEGIHMTVDGKHVTSFPYKAGLEAWFVTEVGVSGDFKLVSAIASGLPTSEDLENSFDLAMLKSSPIPEGKDVDLLIGIFSTANNFKRRMAIRRTWMQYDAVREGAVVVRFFVGLHTNLIVNKELWNEARTYGDIQVLPFVDYYSLITWKTLAICIYGTGAVSAKYLMKTDDDAFVRVDEIHSSVKQLNVSHGLLYGRINSDSGPHRNPESKWYISPEEWPEEKYPPWAHGPGYVVSQDIAKEINSWYETSHLKMFKLEDVAMGIWIAEMKKGGLPVQYKTDERINSDGCNDGCIVAHYQEPRHMLCMWEKLLRTNQATCCN

SEQ ID NO: 67611 - protein, 373 aa, Triticum aestivum
  misc_feature (212)..(212): Xaa can be any naturally occurring amino acid
  unsure (1)..(373): unsure at all Xaa locations
PRLPTTFPEVFNNFGILLGYVSNFAFARLPVHLSWRAMFLVGAVPPVFLGFAVLAMPESPRWLVMRGRIEDARRVLLRTSDSPEEAEERLLDIKKVVGIPADATDADDVVAIVRANEAARGQGVWKELLINPSRPVRRMLVAGLGLMFIQQATGVDCVVMYSPRVFEKAGMKNRTNSLGASMAVGACKTFFIPIATLLLDRVGRRPLLLASXAGMAIFLFTLATSLLMLDRRPESEAKALGAVSIVAMLSFVASFASGLGPVAWVYCSEIYPLRLRAQAAAIGTGLNRLMGGATTMSFLSLSEAITIAGSFYLYACVAAAGWVFMYFFLPETMGQSLEDTGKLFGKDMDDGDTDDGAVVHHERKRSTELITQQ

SEQ ID NO: 67612 - protein, 481 aa, Triticum aestivum
MAAFVLFLCLLVPLVLACAVRARKKGAGGRSSSGGGGGKKGGSSSLPLPPGSMGWPYVGETTQLYSSKNPNVFFARKRNKYGPIFKTHILGCPCVMVSSPEAAKFVLVTQAHLFKPTFPASKERMLGPQAIFFQQGDYHAHLRRLVSRAFSPEAIRGSVPAIEAIALRSLGSWEDLQVNTFQEMKTYALNVALLSIFGEEEMQYIEELKQCYLTLEKGYNSMPVNLPGTLFHKAMKARKRLGAIVAHIISARRERERGSDLLGSFMDGREALTDDQIADNAIGVIFAARDTTASVLTWMVKFLGDNPAVLKAVTEEHAEIAREKALSGEALSWADTRRMRLTGRVIQETMRVASILSFTFREAVEDVEYQGYLIPKGWKVLPLFRNIHHNPDHFPSPEKFDPSRFEVAPKPNTFMPFGNGTHSCPGNELARLEMLVLCHHLATKYRWSTSKSESGVQFGPFALPINGLPMTFTRKDDKNKA

SEQ ID NO: 67613 - protein, 556 aa, Ostreococcus tauri
MMRQRETKEAVARRTLAEFETQIEETARRTGDATTRARVERMLKRLPKQYAMDVNFIEDVLAHAELLGRVEQELQAMGVSSVYCSVREVEVGRAAFGSHEDMMDTDGGIEQLNVTADNGIPIRADSPAGKPRGPTFGSSLQMTSSLGGDPSRGSAGMYEVAVAAGNKPRLLSRVSAVLFDVGLNIAEAHVFCTDDGLALDIFVVTGWKRGEEAAVGHAVQTALDAADFSDIVPASRNASAATPSADEGRMSAGSHGRSTSNDSVSIDGGEWELKESQLVFNEKIASGAFEVAIKVLKSNAQEGNAGNETMREFAQELSILRRVHHKHIIQLIGALTKQKTMCLVTEFMHGGNVLQFVQEHALKLHEIIRFSLGVAMGLDYLHKINIIHRDIKTANLLLDENSVVKIADFGVARLQPTDGSTMTAETGTYRWMAPEVIAHGFYNEKADVYSYGIMVWELESGGEVPYPGYTPLQAAVGVVQRGLRPAISTSCNPKLAQVMQSCWLADATQRPGFEQIISLLKSIDTQKAETDGKHGFFDRLRSVSFKSKKNAPARSS

SEQ ID NO: 67614 - protein, 528 aa, Arabidopsis thaliana
MVIGAAARVAIGGCRKLISSHTSLLLVSSQCRQMSMDAQSVSEKLRSSGLLRTQGLIGGKWLDSYDNKTIKVNNPATGEIIADVACMGTKETNDAIASSYEAFTSWSRLTAGERSKVLRRWYDLLIAHKEELGQLITLEQGKPLKEAIGEVAYGASFIEYYAEEAKRVYGDIIPPNLSDRRLLVLKQPVGVVGAITPWNFPLAMITRKVGPALASGCTVVVKPSELTPLTALAAAELALQAGVPPGALNVVMGNAPEIGDALLTSPQVRKITFTGSTAVGKKLMAAAAPTVKKVSLELGGNAPSIVFDDADLDVAVKGTLAAKFRNSGQTCVCANRVLVQDGIYDKFAEAFSEAVQKLEVGDGFRDGTTQGPLINDAAVQKVETFVQDAVSKGAKIIIGGKRHSLGMTFYEPTVIRDVSDNMIMSKEEIFGPVAPLIRFKTEEDAIRIANDTIAGLAAYIFTNSVQRSWRVFEALEYGLVGVNEGLISTEVAPFGGVKQSGLGREGSKYGMDEYLEIKYVCLGDMNRH

SEQ ID NO: 67615 - protein, 372 aa, Geobacter metallireducens GS-15
MAEKRDYYEVLEVHRNASDTEIKKAFRKLAIQYHPDKNPGDKESEEKFKEITEAYEVLSDSQKRAQYDQFGHAGLGAGGFSSGGFGGFGAGTPFGDIFGDIFGDIFGGRPRGSRGRRGDDLQYNLELSFEEAAFGVEKEILVPFGKRCDECGGSGAKPGTEPKVCPTCRGAGQVRFQQGFFSVSKTCSHCNGEGRVVENPCPTCRGNGMVRDTKTLSVKVPAGVETGTRLKMTGEGGQGTKGGGNGDLYVAIAVKEHPIFTREDNDVICEIPISFVQAALGCEMEVPTLDGKVSMKVPEGTQSGRIFRLRGKGVPQLQGYGRGDQMVVVKVETPSNLNKRQRELLEEFARISGEDAHPMKKNFFDKVMDLFS

SEQ ID NO: 67616 - protein, 751 aa, Halobacterium sp. NRC-1
MPDGDAPDVTPLYEAWSLHGADRYATGDLRARSRYLGLEHDDLRACLTQAADVVDVPAEDGRGTVVPLHAPDTPEPTDEYVVWDPDSDAVGYFDESFGISGAHSRVPLDDVVATAIAHRVRFWHPARAPGGDTDPDGPLAAATVPDGVPPTDPLAGRDRRAFFDTLRETVRGERAAERDQTRDAHADADLRRLVDEHAVDGPFVLVSTTAHSDRPADVRVQYAPDDGAPADIDLVAAFDLYPDNRVLVDAFHDALPFPARVASVDGPLVTLQPTWERVTDPEGVATTLADADPFWLRGLLNPVPYTRRLDAIDAVWETPAKRRLLTGQRPLSFSRPPNRRHADLALDDHQQRALAWAVAADDVACIHGPPGTGKTRTLAAVVAESVARGERVLVTAHSNQAVDTLLVGDSTLDAADDGSLHGVLGDDPTVDIARHGRHSRNRVVDDHYRQRGVDAADVVAATTNGAATFDQNAFDLAVVDEATQASRAATAIAVNAADTLVLAGDHRQLPPYGVREGGAGEMRPSLFETLIDRYGDDVAVLLARQYRMHDAIAGFPNEAFYGGRLETAAVAADRAVDGLPPVAVVDVAGQERRDERGASVRNAAEASVVADRVDTIRRAGVEPGDLGVIAAYSDHVSAIRGVLADRGLDRPALTVDTVDSFQGGERDAVVVSFARSNDAHDAGFLEHPAAGPRRLNVALTRARRHLSLVGDWATLTDPASHRSPAASCADVYADLYDTLADHADARLFNRR

SEQ ID NO: 67617 - protein, 281 aa, Medicago truncatula
MYRENGLLFPWSYLHNFSQELHQLEDYCRNQKFNASMSDLVQFSAMSEYDFAAEGDLFKAPEPMIEESGIDLDPMTAAISMISCGEDVKSTDISILQNEQLLSDVFYDCKKDLFEKAGMESPLSEILEIKVPLLNIDENIIQENKPLPDMPLLLKSVSSGSLSSMDWMHGSAAMKPAFLGISGIDFDAVYGMRRSFSEGDIKTFGNANMNVVQSPVERPFFTSNCSSEERLQKLSRYRNKKTKRNFGRKIKYACRKALADSQPRVRGRFAKNEETDQAKKE

SEQ ID NO: 67618 - protein, 330 aa, Methylococcus capsulatus str. Bath
MLLAGDVGATKTVLGLFDCWGDRLVSLSEAIFASTDYASLETVVAAFLDGQEERRPEVACFGVPGPVSEGRCEITNLPWVLSERELAAATGVSAVRLLNDVQAMALGMAYRLGEDDWVELNPGAGRPRSGNVAVIAAGTGLGEAILYWDGERYHALPTEGGHSDFAPNGPLEEGLLAFLRDRFCGHVSYERILSGSGLANLYDYLRHAGVAPESEALHAALASAPDRAPIIAEWALERRDALCTAVLDLFAAIYGAEAGNLALKSLALGGVILGGGIAPKILPVLQAGRFMAAFTAKGRLSPLLGRLPVRVAIHPQPALLGAAHAASAML

SEQ ID NO: 67619 - protein, 138 aa, Rickettsia akari str. Hartford
MNIIDHFEQENIAKLTANKQIPDFKAGDTVKVTVKVLDRSIEKDGKEKLTERFQAYEGLVIAKRNRGITSSFLVRKISHGEGVERRFMTYSPIVHSINVVKYGVVRRAKLYYLRNRSGKSARIKERHIHIAKTKTVKA

SEQ ID NO: 67620 - protein, 95 aa, Nicotiana tabacum
MRGVLVDWLVEVAEEYKLLSDTLYLAVSYIDRFLSTKVIPRQKLQLLGVSSMLIASKYEEINPPHVEDFCYITDNTYTKEDVVKMEADVLQSLKF

SEQ ID NO: 67621 - protein, 388 aa, Ostreococcus tauri
MWGDAGGDGVQISEIDSGEFVPGRGGRYSVMTPEDSWNVAVGDRRAPSPAIGWHDEEGSSSDALHTEFLINPDDVRLQERIAVGGFAEVFRGTWQGTVVAVKQLLERTSEVKEKLEQEVQVLAKLRHPNLLLFMGYCVDPPLICTEFMRRGSLHTILKAGKPLEPARNHAIALAVARGMSYLHSRSPPILHLDLKSPNILVDEKWRVKIADFGLARMRQTTQMSAKSQFHGTPEWMAPEMLRAEDYDEHADSYSYGVVLWELITAHKPWEDLHPMQIVAVVGYSGRSLELPSEGFPESSHPLTALLADIFTRCARRDPSARPLFPAILTDLERARDLARARAEAAGADKTAARIPPRPDTESVDRRALGVQLEYISLADAVASTDASS

SEQ ID NO: 67622 - protein, 447 aa, Shewanella sp. MR-4
MIKKFFQTGADRPIMDETPEKIRSIYKKYQWQVFIGLVFGYAMFYVVRMALSVVKKPMLDSGVVTIEELGLMGSAFFFTYAIGKFSNGFLADYANIGRFMSVSLMLSSITCMAMGMGVAGLFFVILWGMNGWFQSVGSAPSCVSIFQWYSPKQRGSVYSVWGGSRNIGEAISWILTASLVSFFGWKIGFVGAGIAAFAAAACMLILLKDRPRTYGLPDPATAYGEEPESVKGHDPAAIRKAQLFVLRQPVVWIIALACAAMYSSRYAMSSWAVLYLQSEKNYSLIDAGVAMSSYPIAGFFGAILSGLISDKIFNANRHIPTFLYGLANIIGMSLLFWGSESRMMDAFGLGLIGFSIGGLVVFLAGLTACDLMPKNAVGAVKGFIGLFSYLAASVQEIVSSKLILVTEVAGVKHYDFGSAQYFWLGTSVLSIVLAASVWRAKKVTVVD

SEQ ID NO: 67623 - protein, 399 aa, Rickettsia prowazekii
MSIISTRLNSIKPSPTLAVVKKTLELKKAGVNIIALGAGEPDFDTPDNIKEVAITSIKDGFTKYTNVDGIPLLKQAIKNKFKRENNIDYELDEIIVSTGGKQVIYNLFMASLDKGDEVIIPVPYWVSYPDMVALSTGTPVFVNCGIENNFKLSVEALEHSITDKTKWLIINSPSNPTGAGYNCKELENIAKTLRKYPNVNIMSDDIYEHITFDDFKFYTLAQIAPDLKERIFTVNGVSKAYSMTGWRIGYGAGSKALIKAMTIIQSQSTSNPCSISQMAAIEALNGTQDYIKSNALNFQKKRDLALSILEEVTYFECYKPEGAFYLFVKCDKIFGTKTKSGRIIANSNNFSEYLLEEAKVAVVPGIAFGLDGYFRISYATSMQELEEACIRIKHACNAL

SEQ ID NO: 67624 - protein, 515 aa, Geobacillus kaustophilus HTA426
MFTPYQHEPLTDFTVEKNQRAFQMALEEVSNHLGKEYLLVIGGKRITTTEKVVSINPANKEEIVGIVSKADKRLADQAMEAALKAFETWRKEKPEARAHILFRAAAILRRRRHEFSAYLVKEVGKPWKEADADTAEAIDFLEYYGRQMITLQHGVPVLSRPGERNTFHYIPLGVGLVISPFNFPLAIMAGTTVAAIVTGNTVILRPSDRAPIVAAKFVEVMEEAGLPPGVLNYLSGGEAEVGEYLVEHPKTRFISFTGSRAVGCRIYERAAIVQPGQKWIKRVIAEMGGKDAIIVDKDADLELAAQSIVVSAFGFSGQKCSACSRVIVLEDVYEQVLNRVVELTKQLIVGDPEKPSTFMGPVIDETAYNKVMHYIDIGKQEGKLMTGGEGDSSKGFFIQPTVFANVDPNARIMQEEIFGPVVAFTKAKDFDHALNIANNTEYGLTGAVISRNRPNFEKAREEFHVGNLYFNRGCTGAIVGYQPFGGFNMSGIDSKAGGPDYLLLHMQAKTVSEAF

SEQ ID NO: 67625 - protein, 153 aa, Oryza sativa (japonica cultivar-group)
LLAVDAAATASPAATRGRGRFAYAWVGNAAEQCPGECAWPFHQPAYGPQAPPLVSPNADVGMDGIIINLATLLAGAVTNPYGGGYFQGPTEAPLEAVTACTGMFGAGAYPGYPGQLPVDAATGASYNAVGVAGRRFLLPAMWDPKTSQCSTLV

SEQ ID NO: 67626 - protein, 384 aa, Staphylococcus aureus subsp. aureus MRSA252
MISNKLANIPDSYFGKTMGRKIEHGPLPLINMAVGIPDGPTPQGIIDHFQKALTIPENQKYGAFHGKEAFKQAIVDFYQRQYNVTLDKEDEVCILYGTKNGLVAVPTCVINPGDYVLLPDPGYTDYLAGVLLADGKPVPLNLEPPHYLPDWSKVDSKIIDKTKLIYLTYPNNPTGSTATKEVFDEAIAKFKDTDTKIVHDFAYGAFGFDAKNPSILASENGKDVAIEIYSLSKGYNMSGFRVGFAVGNKDMIQALKKYQTHTNAGMFGALQDAAIYALNHYDDFLEEQSNVFKARRDRFEAMLTKADLPFFHAKGGIYVWLETPPGYDSEQFEQFLVKEKSILVAPGKPFGENGNRYVRISLALDDQQLDEAAIRLTELAYLYE

SEQ ID NO: 67627 - protein, 446 aa, Triticum aestivum
MAATIQSVKARQIFDSRGNPTVEVDVCCSDGTFARAAVPSGASTGVYEALELRDGGSDYLGKGVSKAVDNVNLIIAPALIGKDPTAQTELDNFMVQQLDGTKNEWGWCKQKLGANAILAVSLAICKAGASIKKIPLYQHIANLAGNKQLVLPVPAFNVINGGSHAGNKLAMQEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWVHYAKMTEECGEQVQIVGDDLLVTNPTRVAKAIKEKSCNALLLKVNQIGSVTESIEAVKMSKHAGWGVMTSHRSGETEDTFIADLAVGLSTGQIKTGAPCRSERLAKYNQLLRIEEELGAAAVYAGLKFRAPVEPY

SEQ ID NO: 67628 - protein, 562 aa, Bacillus cereus ATCC 14579
MTTTTTVKSDIEIAQEASMKKIQEIAADLNILEDELEPYGHYKGKLSLDIFKRLQDEKDGKVVLVTAINPTPAGEGKSTVTVGLGQAFNKIGKKTVIALREPSLGPTMGLKGGAAGGGFSQVVPMEDINLHFTGDIHAITTANNALAAFIDNHIQQGNTLGIDTRKIVWKRCVDLNDRALRNVVIGLGGPVQGVPREDGFDITVASEIMAVFCLATDIQDLKARLSRIVVAYNFANQPVTVKDLGVEGALTLLLKDALKPNLVQTLENTPAIIHGGPFANIAHGCNSVIATTMAAKLGDYVITEAGFGADLGAEKFLDIKARAAGIKPEAVVIVATIRALKMHGGVAKDQLKEENVDALAKGMENLQKHVETIQSFGVPFVIAINKFITDTDAEVTYLQEWCNERGYAVSLTEVWEKGGQGGVDLAEKVLKEIEKGENNYAPLYELELPLEEKIRTIAQKVYGAKDIEFAPKARKQLAQYEGEGWSNLPVCMAKTQYSLSDDVTKLGRPSDFIVTIRELKPSIGAGFIVALTGTMLTMPGLPKQPAALQMDVNEDGKAVGLF

SEQ ID NO: 67629 - protein, 304 aa, Zea mays
  misc_feature (261)..(261): Xaa can be any naturally occurring amino acid
  unsure (1)..(304): unsure at all Xaa locations
MQVHDPCPQLHSKPRAALYCTVLLERERRLRRWNLVMGDAYAKRVLLTAAGDTVSRGIACTLTKHGCRLVLLGDEGALAATEEEARRCGVGGGCVELVGLDFKACGEAAADAAVDRAWRCFAGLDAFVNCYSYEGEVQDCLSISEDEYRKTIKVNVITPWFLMKAIAKRFQDTKSGGSIVFLTQIIGAERGLYPGAAAYGTSLGAIHQLVRLCAMELGKHKIRVNAACRGLHLQDKFPVSVGKEKAEKATAEVMPLRRWLXDPEKDLASTVLYLVGDESRYMTGTTIFVDGAQSIVRPRLRSFM

SEQ ID NO: 67630 - protein, 439 aa, Oryza sativa
METEANGGREAKAMKDHIDLECSQAKKPQPKDLKEIAGSFWLAASVFSKKWQKWRRKQKLKKQDAAGSKAAAAAMPPPEKPSKPSFLRRSRLRGEACSEFAGGRRSCDTDPRFSLDAGRMSVDDVGFSWDEPRASWDGYLFGAGTGIGLGRAPPPLSRLPPILSAMEDSPAGIVERSDGQIPVEDDSQPEPDPDADTPGGSVQTRDYYDTSSSSRRRRSLERTSSVRRPSFEVTDAKPVLPAAAAITSVKDSPLIGSSEFYHFQHAEDLLEHHRFSTSSLIEDFPMSLDAAFPGPDKKPRRWRKAWSLWGLIHRRAAGRRGGASDVADRAFSEPWPELRVRGCNARMQRCNSNASARSSFSSNSGGLGSSRRSYVDGNGNVVKRRREECALERNRSARYSPGHADNGMLRFYLTPMRSASGPGAPRGAYPGPKGGGGKT

SEQ ID NO: 67631 - protein, 337 aa, Oryza sativa
MAGGVSSVEVVKDGATGLEKLVLREAHGCSVQVDPLSSTLAFSCNVDKLFIGGGHHDAIVSCGFDWPFAIILSILGNVILDNLTGSLLSFFFLRNGQFGNHGVLEQHGFARNRLWSVDETPPPFPATTSNCHIDLILKQSPEDLKIWPHSFEFRLRVALSPTGDLMLTSRIKNTNADGKPFKFGFSYNTYFSVSDISEVRVEGLETLDYIDNLQCGKRCTEQGDAVVFESEAEKVYLSAPPKIVIIDHDKKRTFELRKEGLPDVVVWNPWDRKAKTILDFGEEEYKCMLCVGAANAEKPITLRPGEEWQGRQEISVVPSSYSSGQWDPEIIHRIQDI

SEQ ID NO: 67632 - protein, 292 aa, Aspergillus nidulans FGSC A4
MSEITHPTIKDGWFSEQSEMWPGQAMNLRVNQILHHEKSKYQDVLVFESSDYGTVLVLDNVIQCTERDEFSYQEMITHLAMNSHPNPKKVLVIGGGDGGVLREVVKHETVEEAILCDIDEAVIRVSKKYLPGMSIGFQHPNVKVHVGDGFEFLKQRQNEFDVIITDSSDPEGPAESLFQKPYFELLRDALRDGGVITTQAENQWLHLPLIADLKKACNEVFPVAEYAYTTIPTYPSGQIGFMVCCKDANRNVKEPVRTWSREEEERLCRYYNQDIHRASFVLPNFARKALGN

SEQ ID NO: 67633 - protein, 208 aa, Bacillus halodurans C-125
MKPIRIGIGGPVGSGKTHLVEQLTRAMHESYELAVITNDIYTKEDAQFLVKHGILPEDRIIGVETGGCPHTAIREDASMNFEAIHELKQRFTNLDIIFVESGGDNLSATFSPELVDGFIYVIDVAEGQDIPRKGGPGVTRSDLLVINKIDLAPYVEVDLDIMEEDAKQARGERPFVFTDQKRGKGIETIIDWIKRELLLEDMVKEPSV

SEQ ID NO: 67634 - protein, 692 aa, Aspergillus nidulans FGSC A4
MGYTELDQLAINTIRLLAVDATAKANSGHPGAPMGMAPVAHVLFNKFMKFNPKNPEWANRDRFVLSYEAHFSCDNGHGCMLQYALLHLFGYGISMDDLKAFRQLDSITPGHPEAHDTPGIEVTTGPLGQGFANAVGLAIAQAHSGGVFNKPGYNLFDNYTYCFFGDGCAMEGVASEAASTAGHLKLGNLIAIYDDNHISIDGDTKCAFTEDVTKRFEAYGWHVVWVKDGDNDLEGIEAAIKEAQAVKDKPSMIRLTTTIGFGSKLQGTGGVHGNPLKADDIEGVKKRFGFDPAQSFVVPQQVYDLYHKHAEEGAAQEQEWNQLLQKYAGEYPNEHADLTRRLSGKLPEGWEKSLPVYKPSDPAIASRKLSEAVLEKIHSVIPELLSGSADLTGSNNTRWKNAVDFQPPEYGIGEWSGRYLRYGVREHAMAAIMNGLAAYGTVIPAAGTFLNFVSYAAGAVRLSALSRVRAIHVATHDSIGLGEDGPTHQPIETLAHFRALPNCMVWRPADGNETSAAYYSALTAKHTPSILALTRQNLPQLENSSIEAALKGAYPVFEAADAKVTIISTGSEVSICIDAAKYLQEKHGVVARVVSIPCFEVFDAQDKEYRLKVLPDGIPILSVEVCSTMGWERYSHEQFGLNRFGASGPYKEVYAKFEFTPEGISKRALATIDFYKGVPVRSPINRAFQQIL

SEQ ID NO: 67635 - protein, 560 aa, Pseudomonas fluorescens PfO-1
MLQTRVIPPAEGAYQYPLLIKRLLMSGARYEKTREIIYRDQLRYSYPTLIERVAQLANVLTAAGVKAGDTVAVMDWDSHRYLECMFAIPMIGAVIHTINVRLSPEQILYTMNHAEDRFVLVNSEFVGLYQAIAPHLTTVEKTLLLTDLPEKTADLPNLVGEYEQLLAAASPQYDFLDFDENSVATTFYTTGTTGNPKGVYFTHRQLVLHTMGVSTIMGAIDSVRLLGTNDVYMPITPMFHVHAWGLPYVATMLGLKQVYPGRYDPEFLVELWRKEKVTFSHCVPTILQMVLNAKGAQGTDFGGWKIVIGGSALNRTLYETAKSKGIQLTAAYGMSETGPLVSCAHLNDELMAGTEDERTTYRIKAGVPGPLVEAAIVDTEGNFLPADGETQGELVLRAPWLTEGYFNEPQKGAELWAGGWLHTGDVATLDAMGVIDIRDRIKDVIKTGGEWISSLDLEDLISRHVAVREVAVVGIADPQWGERPFALLVVREGHAIGARELKEHLKPFVELGHLSKWAIPSQIALVTEIPKTSVGKLDKKRIRLDITEWQANNSTFLSTL

SEQ ID NO: 67636 - protein, 130 aa, Methanocaldococcus jannaschii
  misc_feature (41)..(41): Xaa can be any naturally occurring amino acid
  misc_feature (111)..(111): Xaa can be any naturally occurring amino acid
  unsure (1)..(130): unsure at all Xaa locations
MSLMDPLANALNHISNCERVGKKVVYIKPASKLIGRVLKVXQDNGYIGEFEFIEDGRAGIFKVELIGKINKCGAIKPRFPVKKFGYEKFEKRYLPARDFGILIVSTTQGVXSHEEAKKRGLGGRLLAYVY

SEQ ID NO: 67637 - protein, 338 aa, Cryptococcus neoformans var. neoformans JEC21
MSVPCISLHDFDERRDEVIKELMDASMNVGFFTLCNHGISPEDVQAAFDLSRRFFALPDEIKIKTPLNGRNAGWEKNTQVRPSTGTADQKESMQLQFARMEGLWPSDEDVPGFRTRAEKFMNQIQALSIKVMECFADGLGLPHDIFTENTVERGENDCQNVLRLLHYHSIEDKQFGPNFWRAGAHADFDILTMLFQRDGEGGLEVCPGRKVVGDFGMGQTWIPVEARQDRIVCNIGDQLMRWSDDQLKSTYHRVRLPEGNESKGPRYSIAFFNQSRINTVIQGPQKKYPPITGGKFIAEAMAKNRMQSADIARRVALETGENFATEVHFVPKHLQVVA

SEQ ID NO: 67638 - protein, 238 aa, Glycine max
  misc_feature (80)..(80): Xaa can be any naturally occurring amino acid
  unsure (1)..(238): unsure at all Xaa locations
SARALTSSSSTFIPKRYSFFFFLSILFALRSSSGGCSEYHHHHAPMATIGGLRDSQGSQNSVQTEALARFAVDEHNKKQXVRTQEQVVAGTLHHLTLEAIEAGEKKLYEAKVWVKPWLNFKELQEFKPAGDVPSFTSADLGVKKDGHQPGWQSVPTHDPQVQDAANHAIKTIQQRSNSLVPYELHEVADAKAEVIDDFAKFNLLLKVKRGQKEEKFKVEVHKNNQGGFHLNQMEQDHS

SEQ ID NO: 67639 - protein, 379 aa, Streptococcus mutans
MKNEMLALILAGGQGTRLGKLTQSIAKPAVQFGGRYRIIDFALSNCANSGINNVGIITQYQPLALNSHIGNGSSWGLDGINSGATILQPYSATEGNRWFQGTSHAIYQNIDYIDSINPEYVLILSGDHIYKMDYDDMLQTHKDNMASLTVAVIDVPLKEASRFGIMNTDSNDRIVEFEEKPEQPKSTKASMGIYIFNWDRLRTMLVDAEKNNIDMSDFGKNVIPAYLESGERVYTYNFNGYWKDVGTIESLWEANMEYIGEDNDLHSRDRSWKIYSKNLIAPPNFITEEAHVKDSLVVDGCFVSGKVEHSILSTNVQVKEGAQIKDSFIMSGAVIGEGAKITRAIVGEGAKIGEDVEIDGTEEVQVIGYNEVVGVPNED

SEQ ID NO: 67640 - protein, 331 aa, Ostreococcus tauri
MSEADGIYVETVRDMYESWVVYNFLNLCLEYVGGPGAIVNAMTGKEVKAGSWLRGTCVYDRDLVVDGHYIRRCKQGCLQFVFIKPLLSVLEIVLQAKGKLGDGQINFLKAYVYILFVYNISYSLALYALWMFYLGAHDPLAKYNPLLKFIIVKSVIFFSFWQSVFTAMAVRTGTLESPLEGRAVQNVLICVEMFIVSFLMWFAFPYKDFVDPEGVKRGFVSNVVNFVSVRDVFDDTVHQFGATYQEYTLHGDGETPDRTVRMRTFVPTGRSSAPAEDERDTASLSANMAMENAFFHDEERANGPVGLDRSDAPRSPGRPVELVSIEEGQRL

SEQ ID NO: 67641 - protein, 176 aa, Burkholderia vietnamiensis G4
MSSRRIAVRRSGIHGKGVFAVEPIKAGERVVEYKGERISWKEALRRHPHDPNDPNHTFYFALEDGGVIDGKVNGNSARWINHSCTPNCEAEEIKGRVFVHALRDIEPEEELFYDYGLVIDEKLTKKLKREYACHCGAETCRGTLLATPDDDGKKKKKKDKKDGKAESGAKDKKKKK

SEQ ID NO: 67642 - protein, 242 aa, Vibrio vulnificus YJ016
MSAHHLPIFVLLCHNVSNNTYLVKAVLMKFNAAIFDMDGLLLDTERVCMRIFKQACDVQKLPFYQETYLSIIGRNSAGIDAILRAAYGDDLDRLHAEWRKRYNQVVLHEAIPVKEGVIALLEWLKSHQIPAAVATSTQKDVALVKLKLAGLDHYFESITTGCEVTHGKPDPEIYLLAASRLNVPPAQCLAFEDSNNGVRAAVAANMMTYQIPDLVEPCEEVIAFGHRICPSLTEVLKELQPD

SEQ ID NO: 67643 - protein, 259 aa, Tropaeolum majus
MASAREESVYMAKLAEQAERYEEMVEFMEKVSASAEGEELTVEERNLLSVAYKNVIGARRASWRTISSIEQKEEGRGNEDHVTVIRDYRSKIESELSNICDGILKLLDTRLIPSASSGDSKVFYLKMKGDYHRYLAEFKTGAERKEAAESTLTAYKAAQDIANSELAPTHPIRLGLALNFSVFYYEILNSPDRACNLAKQAFDEAIAELDTLGEESYKDSTLIMQLLRDNLTLWTSDMQDDGADEIKEAAAPKPAEEQQ

SEQ ID NO: 67644 - protein, 495 aa, Geobacter metallireducens GS-15
MFTFLTAAHAGSINDQSAFIERRGAGMKKVIVVGGGISGLATAFELRNKGAEAGIELDVTLLEKEERVGGKIWSIKEEGYLCEWGPNGFLDSKPQTLDLCRDLGASERLLRSNDNARKRFIYTGGVLNRLPENGPTFLKSSLISWPGKLRLAMEPFISKRTDGTDETLASFGRRRLGEEALQKLISPMVSGIFAGDPETMSLRSCFPRIAELEDEYGSLIKAMIKLAKKKKQEAAQGKAVSSAAGPGGVLTSFRWGIQELTDILAEQLGSATVVTGQPVTGLTRGSSVPWRLKTPTVDIDADVVILASPAHATAGIVSGVDAAMAQVLGEIPYASMTVVCFGFERERIAYDLNGFGYLIPKDEGMNTLGTLWDSSIFENRAPEGKVLLRSMLGGACFPEYVKLSDAEVMQRVKADLKATMGITADPSFIRIFRHPQAIPQYTVGHGKRLAALQERSSALPGLFLTGNSYRGIGLNDCATAANRTTDEVVAYLKGR

SEQ ID NO: 67645 - protein, 559 aa, Bacillus cereus ATCC 14579
MDDVVTESRNPISKFFAKIGRQKRYMRVSSIAIKHGMGKYLALKRSPEADRKLATSLRNTLEECGGVFIKFGQVLSTRSDLLPPVFIHELSNLQENVTRLSQKQVEEILKKELHTPKDEIFSSFEMEPLAAASIGQVHKAKLKENDQDVVVKLLRPNISETIKRDLDILIHFSLWISNKSTWAKNIGFLDLAHGFSIAMKEEIDFKIEARNFEQVSDSLKNSETKVKIPKVYKKYSNSKILVLEFLDGVSVKSGSALLNELQIDTKKVQRQLFDCILEQIFFKGIFHADPHPGNVYILRDGTPALLDFGSVGRLGTLQQDAFKRLLIGFERKNSYVLLDGLLQLVEKKPNVDKEGLEQSISQLLIQSTYGSTNGSEEFIQGLFQIIAEFELAFYPMVAGAFRSLITLEGTMLQLNPEFNLMDEAKRFAKDHAASFMPVNNYSSLKEAATNELLAMLPAMRRIPRKLDDLSSKLENGELSVKVGFFSDETNASFITTFISQFLIAFIGTAFGGISVGVLHLANSATEPNDQFLSVVGYGGLFISAILLVRVAIHAVRKFK

SEQ ID NO: 67646 - protein, 311 aa, Oryza sativa
CAVYMHCEGCARKVRKILKGFDGVEDVIADSKAHKVLVKGKKAAADPMKVVERVQKKTGRKVELLSPMPPPPEEKKEEEKKEEPEPPKPEEKKEPPVIAVVLKVHMHCEACAQGIRKRILKMKGVQSAEPDLKASEVTVKGVFEEAKLAEYVHKRTGKHAAIIKSEPVAPPEKVAAEGGDEKKAAEGGDEKKDEKEEKKDGKEEGGNGGGDEKKEEKEKEKEGGNADGEEKDKDKEKDPAAIAAANLYLHYPRFAFPAGYYPPGPGYAYPPPYPPSYPPPYQPSYPPYPSHPSHHPSQIFSDENPNACSVM

SEQ ID NO: 67647 - protein, 399 aa, Glycine max
  misc_feature (115)..(115): Xaa can be any naturally occurring amino acid
  unsure (1)..(399): unsure at all Xaa locations
MEDPEVIIGSLNPNDTRGKTVTCKAAVAYGPGEPFVVERVLVHPPQKMEVRIKILFTSICHTDLSAWQGENEAQRAYPRIFGHEASGIVESVGEGVNDMKEGDLVVPIFNGECGXCKYCKCEKTNMCERFGVDPMKKVMASDGATRFSTMDGKPIFHFLNTSTFTEYTVVDSACIVKIHIDGSNGDLNRNIKRLTLLSCGVSSGVGAAWNTADVHFGSTVAVFGLGVVGLAVAEGARARGASRIIGVDINSDKFIKAREMGITDFINPKDDERPVYEIIGEMTGGGVHYSFECAGNLNVLRDAFLSAHEGWGLTVLVGIHLSPKMLPIHPMELFHGRRIVGSNFGGIKGKTQLPHFAKECMNGVVKLDDFITHELPFKEINQAFDLLTPGKSLRCLLHF

SEQ ID NO: 67648 - protein, 317 aa, Mycobacterium sp. MCS
MSLHALVIGEALIDIVERDGVVQGEHVGGSPLNVAVGLSRLGRGVDFLTHIADDARGRRIVEHLEAAGVHLVAGSRNAARTPTARAMLDDKGSARYEFDIDWNLTGTPEAAPPLVAHTGSIATVLEPGCRATAALLDAYHLSATITFDPNIRPALIDDADAARARIDRLVERADVIKASDEDLRWLDPNRTPKQIARAWLQLGPSIVAVTEGGQGAFAVCAAGSARVAALPVEVVDTVGAGDAFMSGLIDALWTHGLLGAEKRRELRAIRLDALHDVLQTAALSSALTVTRAGADLPDRATRDAAAREPATLIDRRR

SEQ ID NO: 67649 - protein, 457 aa, Mannheimia succiniciproducens MBEL55E
MKTLCKSSTRFDKQALSLGFSELILQENAARGVAELVRQKLQTGEKILFLCGGGNNGSDAIACARMLSGDYECELYFITENLNANAQAQLNIALKVGVNRVSQPDLANIGCVIDGMFGSGLSRDLDAEIIRLLDRINAHNALKIAIDFPSGLDGNGNIRGACFKTDFTLAMGALKIGLFSDVAKDMTGEVSLVNLGLSDNRFITNQEDFLLERTDLNLPSRTLQNVHKGSFGHAFVALGQMPGAGIMAATAALIMGAGKVSVVGKAENLTPQIMQKNNFDGAGAVAIGIGLGNADIDISAIKHLPCVLDADLCYRAEIREFLPNPSAVFTPHPKEFSGLLRNLGLADISIEEAIKNRFELAREFSRQIKGVLLLKGANPIIAYNGTLYLCNLGSNKLSVGGSGDVLAGIILGYLAQGFTALEAAQNAVLAHAKSAENYQGNDYSMTPLDLIDGLRYL

SEQ ID NO: 67650 - protein, 110 aa, Mannheimia succiniciproducens MBEL55E
METLDKIKKQIAENPILIYMKGSPKLPACGFSARAVEALINCQVPFGYVDILQHADVRAELPKYANWPTFPQLWVEGELIGGCDILLEMYQAGELQTLLKEVAERHKEQV

SEQ ID NO: 67651 - protein, 476 aa, Glycine max
MKKENSVMLKAGELPGRLTRARAAAALRAYGQLPPLKERAQQNQNQLSRVNSKRAVSDNTCLQRKRKAVLQEVTNVCRENAYKGCFNSTKIQAKKSKLAKAGQINVSKVAPSVTVEPRQFQVDSKAKETALQSEDTMCSINLENNEFLRLSANDCSKDFRLPESQMSGISAHPLISQKKDKKDNLPKLLTALKDPDITNIDDDDLEDPQSCSLYAADIYDTMRVAELARRPHPNFMETVQRDITQSMRGILVDWLVEVSEEYKLVTDTLYLTVYLIDWFLSKNYIERQRLQLLGITCMLIASKYEEINAPRIEDFCFITDNTYTKAEVLKMESQVLKSSEYQLYTPTIQTFLRRFLRAAQASYKDQSLELECLANYLAELTLMDYGFLKFLPSIIAASAVFLARWTLDQSNHPWNPSFQHYACYGASDLKTTVLALQDLQLNTDGCPLTAVRTKYRQDKFKCVAALSSPKLLETLF

SEQ ID NO: 67652 - protein, 512 aa, Arabidopsis thaliana
MSATLKNPVIKLKLLIDEEKNKVVFVEAGKDFVDLLFSFFTLPMGTIVRLLEMYKKSQKIAIGCFSNIYASVVSMGIEHFLTEACKQMLLYPGSLNHEKCRNLKLRVDDSEATKYFVCPKFVEREQCTESYSNFNTSRCSCGVLMNEVTQLDGRGGLASAGNGVEGGVFVRSDHTSFMITDDLKVEITSVRLTLNVLKDLGYVDCEKLDEKIHDVNLEEVPTLLECLSTSDNPLTDTFLKKKSSYSTKRIQKLPSPGLCEDREESTPDQTITLNVVKKEGNILFVECGDDFVDLLFTFLAIPLESAWGIAGDGIIIGCIGNLSKSFKDLSVDPGREAKCVLPHYYKCQKQLLDAVTTHKPPTFYLYVSSMASNHIREYRLSEDSSKPLVYFWDELMPMISIDPKSKGSTNTTDESTIPSGGFMKRGTKFMITDDLIITPLNSTSTIGLVKEKQIRLDDVEVQEIIIRKEEAIRLLQASLVTCSALSTGLLAIESASTSVPQSANLKKPKIET

SEQ ID NO: 67653 - protein, 518 aa, Medicago truncatula
MAGGGIPIGGGNKEYPGNLTPFVTITCIVAAMGGLIFGYDIGISGGVTSMDPFLKKFFPAVYRKKNKDKSTNQYCQYDSQTLTMFTSSLYLAALLSSLVASTITRRFGRKLSMLFGGLLFLVGALINGFANHVWMLIVGRILLGFGIGFANQAVPLYLSEMAPYKYRGALNIGFQLSITIGILVANVLNYFFAKIKGGWGWRLSLGGAMVPALIITIGSLVLPDTPNSMIERGDRDGAKAQLKRIRGIEDVDEEFNDLVAASEASMQVENPWRNLLQRKYRPQLTMAVLIPFFQQFTGINVIMFYAPVLFNSIGFKDDASLMSAVITGVVNVVATCVSIYGVDKWGRRALFLEGGAQMLICQVAVAAAIGAKFGTSGNPGNLPEWYAIVVVLFICIYVAGFAWSWGPLGWLVPSEIFPLEIRSAAQSVNVSVNMLFTFLVAQVFLIMLCHMKFGLFLFFAFFVLVMSIYVFFLLPETKGIPIEEMDRVWKSHPFWSRFVEHGDHGNGVEMGKGAPKNV

SEQ ID NO: 67654 - protein, 850 aa, Zea mays
MQMPFCPSLNLWDRSPAHAPENHIAIDGTVVVSCHFGLSLPGKTTTLRLFSSTQMDPNTGKGKLSAEAPLRGGKKTKQQGRKTSTMAYQVTFFVDAEFGTPGAVVVKNGLRNDQFFLRHVQLNLPEDGRSVHFECNSWVYPYKKTNADRVFFINTSYLPDRTPQALRLLRDEELRSLRGNGRGERKDWERVYDYDLYNDLGDPDKEDRARPALGGTATHPYPRRCRTGRPLFKTDGVTETRKHLINLDFYIPPDERFSPTKLAEVLALAVQAVTHFVVPESNALFHGNVNSFRSFDQLKDDLYGRRPPVAVDGQVMDKLKTSVPSHKTYKQVSKMVKETPVKFPIPQVIEHDQEAWRSDEEFAREMLAGLNPVVISRLEVFPPVSRGGKKSSITEAHIESQLQGRTVQKALDDKRLYLLDHHDYLMPYLRRINTQQGVCVYASRTLLFLRDDGALKPLAIELSLPGDGAEVSSRVILPATPGTTDGHLWWLAKAHVSVNDSGYHQLISHWLFTHATVEPFIIATKRQMSAMHPIHKLLEPHFKDNMQINTLARSILLSAGGILERTMYPGKYAMEMSSAIYSEWRFTEQSLPNELVKRGMASKMGGGAIALHVEDYPYAVDGMDVWRAIEGWVRTYCAHFYHSDAAVAADAELQAWWDDVRRVGHGDRQRDPACWLDLDSVANLAESLSTLIWIASALHAAVNFGQYGYAGYMPNRPTRCRRFVPLPDSPEMAQLEADPDRFFLDTVPDRFTATLGLTLIEVLSNHTSDELYLGQRATAAWTDDGEVLQLLDRFREELRRVEKRITERNRDPRLKNRKGPAKVPYTLLFPDVGGKEKGITGKGIPNSVSI

SEQ ID NO: 67655 - protein, 214 aa, Gracilaria lemaneiformis
MARSDDEYDYLFKVVLIGDAGVGKSNLLSRFTRNEFSLESKSTIGAEFATRSIQCEGKIIKAQIWDTAGQERYRAITSAYYRGAVGALLVYDITKKDSFDNVQRWLKELKDHADANIVIMLVGNKSDLQHLKAVTTDDASAFAESNGLSFIETSALDNSTVEEAFRSILSEIYRLGSKKALEKGSTSNFAPNATQTIVINPPADEGKTEKAKCC

SEQ ID NO: 67656 - protein, 488 aa, Arabidopsis thaliana
MKMMMMIILLLCSIILITILFFKKQSRGKKSNAPPSPPRLPLIRNLHQLGRHPHRSLCSLSHRYGPLMLLHFGSVPVLVVSSADAAKDVLKTHDRVFASRPRSKIFDKIFYNGRDVALAPYGEYWRQMKSVCVLHLFSNKMVRSFRDVRQEEISLMIEKIRISSSLRINLSEILVNLTNNVICRVALGRKYGGKTDFKDLMKRLTRLLGEFSVGSYVSWLAWIDWIRGLDGQLIKISNDLDEFLERVVQDHVDGDGHKNDFVDFLLTIEREKSVGFEIDRLSIKAIILDVFVGDMDTTYTLLEWAMTELLCHHECLDRLQEEVRMVCKDKSGVSEDDLQDMKYLKAVIKETLRLHPPLPLMVPHESTHDVKLRDYHIPAGTHVMINAWAIGREAATWGPDAEEFRPERHLNSYVDYRGQDTELVPFGAGRRICPAISFAVVLDEVVLANLVHQFDWTLPEESTEYQTDVAESTGMAVHRMFPLFAMTT

SEQ ID NO: 67657 - protein, 214 aa, Gracilaria lemaneiformis
MARSDDEYDYLFKVVLIGDAGVGKSNLLSRFTRNEFSLESKSTIGVEFATRSIQCEGKIIKAQIWDTAGQERYRAITSAYYRGAVGALLVYDITKKDSFDNVQRWLKELKDHADANIVIMLVGNKSDLQHLKAVTTDDASAFAESNGLSFIETSALDNSNVEEAFRSILSEIYRLGSKKALEKGSTSNFAPNATQTIVINPPADEGKTEKAKCC

SEQ ID NO: 67658 - protein, 253 aa, Pteris vittata
MARKFFVGGNWKCNGTVAEVNKIVKLLNEADVPSEDVVEVVISPPFVFLPQVKAVLRSDFAVAAQNAWVRKGGAYTGEISAEMLINLEIPWVILGHSERRALLKESNEFVADKVAYALSQGLKVIACIGETLEQREAGETLNVVSEQTKAIAEKIKDWSNVVLAYEPVWAIGTGKVATPVQAQEVHADLRSWLATNVSSDVAESVRIIYGGSVNAGNCVELAGQPDVDGFLVGGASLKAEFVDIIRSALVSKS

SEQ ID NO: 67659 - protein, 550 aa, Oryza sativa
  misc_feature (14)..(14): Xaa can be any naturally occurring amino acid
  misc_feature (30)..(30): Xaa can be any naturally occurring amino acid
  misc_feature (40)..(40): Xaa can be any naturally occurring amino acid
  misc_feature (66)..(66): Xaa can be any naturally occurring amino acid
  unsure (1)..(550): unsure at all Xaa locations
MSAAHLLRHSRKLXRSLHNALDCERSGPRXRYFSTASGSXFPTKGNVLLVSTGAEKRIGGARFPQXKQPGKELETSKLSLGLNGSYTCRRSPNNFIPNTITGLNGSLSCGQIASARSFSSSADLPPHQEIGMPSLSPTMTEGNIARWLKKEGDKVSPGEVLCEVETDKATVEMECMEEGYLAKIIHGDGSKEIKVGEIIAVTVEEEGDIKKFKDYKPSTLAAPVAPSELKAQSEPTEPKVEEREPSKASELKAPRTEEPSRSGDRIFSSPLARKLAEDNNVPLSSVKGTGPDGRILKADIEDYLAKGCRKEALAAPGLSYTDVPNAQIRKVTANRLLSSKQTIPHYYLTVDTRVDNLIKLRGELNPLQESSGGKKISINDLVIKAAALALRKVPQCNSSWMNDFIRQYHNVNINVAVQTEHGLFVPVIRDADKKGLGMIAEEVKQLAQRARDNSLKPDDYEGGTFTISNLGGPFGIKQFCAIINPPQSAILAIGSAERRVIPGSANGQYEFGSFMSATMSCDHRVIDGAIGAEFLKAFKGYIENPTSMLL

SEQ ID NO: 67660 - protein, 266 aa, Glycine max
PPSSEFLSLTTTTPFFTSSHSPFHRVLIMLGKRPRPMIGKLSELLVSRGRTVAYLDTTGSPRGPLDMKMMQSSPRGLKNYDLGGVGLGIVVALDKSNEVAAREVLPKHAVCTSNLNRSGPIPVHYTKNPDEFDVEEYTYVTCHVPNKTFTKVYYDGGEGEIRRHYNNSNVGVLRRTAPQPLIVEAESLYPTSNFLSSCHLCGKKLHGKDIYMYRGEKAFCSPECRSSQIMMDERKERCRSEASRSVEMSSSPYAREQIFSTGILAL

SEQ ID NO: 67661 - protein, 496 aa, Magnaporthe grisea 70-15
MSLVTELKTPVTGAYQQPTGVFINNEWVEGVDKKTFETINPSTEEVICSVSEATEKDVDIAVKAARKAFEGEWKQTAPGQRSKLLTNLAELVEKNLDLLAAVESLDNGKSLAMAKGDVGAVAGCLRYYGGWADKIEGKTIDIAPDMFHYTRSEPIGVCGQIIPWNFPLLMLAWKLGPALATGNTIVLKTAEQTPLSALVFANLIKEAGFPAGVVNIISGFGKVAGAAISAHMDIDKVAFTGSTVVGRTIMKAAASSNLKKVTLELGGKSPNIIFNDADIEAAVSWVNFGIYYNHGQCCCAGSRIYVQEGVYDKFVAAFKERAEKNKVGDPFKEDTFQGPQVSELQFNRIMEYIKSGKEEGATVETGGERHGDKGYFIQPTIFSNVRPEMKIMKEEIFGPVVAMAKFKTEEEVIALANDTNYGLAAAVHTKDLNTSIRVSNALKAGTVWVNCYNMLHHQLPFGGFKESGIGRELGEAALANYTQNKSVAIRLGGPIF

SEQ ID NO: 67662 - protein, 493 aa, Arabidopsis thaliana
MVSSVSLFASLTPYLVSALLLFLLLEQLFYRVKKRNLPGPLFVFPIIGNVVALIRDPTSFWDKQSAMADTSVGLSVNYLIGKFIIYIKDAELSNKVLSNIRPDAFQLTGHPFGKKLFGDHSLIFMFGEDHKSVRRQVAPNFTRKPLSAYSSLQQIVILRHLRQWEESFSSGSRPVSMRQLIRELNLETSQTVFVGPYLDKEVKKTICDDYSLLTLGTMAIPIDLPGFTFGEARQAVSRLVNTMSVCVGKSKAKMAAGENPTCLVDFWTHSIIEENPPPPHSKDKEISCVLVDFMFASQDASTSSLLWAVVMLESEPEVLRRVREDVARFWSSESNELITADQLAEMKYTRAVAREVLRYRPPASMIPHVAVSDFRLTESYTIPKGTIVFPSLFDASFQGFTEPDRFDPDRFSETRQEDEVFKRNFLTFGNGSHQCVGQRYAMNHLVLFIAMFSSMFDFKRVRSDGCDDIVHIPTMSPKDGCTVFLSSRLVTSP

SEQ ID NO: 67663 - protein, 355 aa, Arabidopsis thaliana
MADEKENCVRMTRAATKRKASMEAAIDKERINKKRVVLGELPNLSNIKKSRKATTKQKKKSVSIPTIETLNSDIDTRSDDPQMCGPYVTSIFEYLRQLEVKSRPLVDYIEKIQKDVTSNMRGVLVDWLVEVAEEYKLLSDTLYLAVSYIDRFLSLKTVNKQRLQLLGVTSMLIASKYEEITPPNVDDFCYITDNTYTKQEIVKMEADILLALQFELGNPTSNTFLRRFTRVAQEDFEMSHLQMEFLCSYLSELSMLDYQSVKFLPSTVAASAVFLARFIIRPKQHPWNVMLEEYTRYKAGDLKECVAMIHDLYLSRKCGALEAIREKYKQHKFKCVATMPVSPELPLTVFEDVNI

SEQ ID NO: 67664 - protein, 276 aa, Hevea brasiliensis
DKIVVDKPIYVKALMSKTAGSIVGAALRRDPHEAEFIQSVQEAVHGLERVIAKNTHYVNIMERLLEPERMLLFRVPWVDDRGETHVNRGFRVHFNQALGPCRGGIRFHPSMNLSIAKFLGFEQTLKNALSPYKLGGAAGGSDFDPKGKSDNEIMRFCQSFMNEIYRYLGPDKDLPAEEMGVGTREMGYLFGQYRRLVGHFQGSFTGPRIFWSGSSLRTEATGYGLVFFAQLMLADMNKELKGLRCVVSGSGKIAMHVLEKLIAYGAVPVTVSDSKG

SEQ ID NO: 67665 - protein, 408 aa, Mycobacterium sp. MCS
MLPDTDRRTRSTWLLLGPAFVAAIAYVDPGNVAANVSAGAQFGFLLVWVIVLANVMAGLVQYLSAKLGLVTGRSLPESVAGRTRTPTRIAYWLQAELVAMATDLAEVVGGAIALYLLFDLPLLIGGVITGAVSLALLAVQNRRGQRHFERVISSLLLIIAIGFLTSVFVEPPPVADVAGGLIPLFEGTDSVLLATAMLGATVMPHAVYLHSGLARDRHGHAEPGARRRLLLKATRIDVGLAMLIAGAVNMSMLLVAATNLQGMSDTDTLEGAHAAVQQTLGPAVALCFAIGLLASGLASTSVGAYAGAMIMGGLLRRTYPLLVRRLVTLVPALAILAIGVDPTRALVLSQVVLSFGIPFALIPLIRLTSDRAVMGDDVNHRITTTLGWVVAGLISLLNVVLIYLTVTG

SEQ ID NO: 67666 - protein, 307 aa, Oryza sativa
  misc_feature (123)..(123): Xaa can be any naturally occurring amino acid
  unsure (1)..(307): unsure at all Xaa locations
MAETLDMTLDDIIKNNKKANPSSGRGRRGSAAGGGGGGGGGVGGGGGGGVGPTRRPFKRSGNRAGPYQPPKAPESAWQHDMYSDVAAGGGGGSGGGGRVSAIETGTKLYISNLDFGVSTEDIXGDLKKYVIHYDRSGRSKGTAEVVFARRGHAVAAVKKYINVQLAGKPKKIEILGTNTPTVAAALPANNGGYVRNVPKTCTKGWPSCTPPQVALVQGGLGAPVAGGGGNGGPGVSGVPQGNEVSPTPPPPPPPTPPPPPPPPPAADPRRPRPDEGLAFLLFLMMSSSVMSRVSAMAAARGRVDLAR

SEQ ID NO: 67667 - protein, 457 aa, Mycobacterium sp. MCS
MSSTTPLNPSVGEGEGQLRRVLGVPSLVLFGLVYMVPLTVFTTYGIVTVESGGRVPLAYVVTLAAMIFTARSYARMAAAYPVAGSAYAYTQKTFGAPVGFLAGWSLLLDYLFLPMLNYLVIGLYLNAAVPAIPQWLIVVVTIAIVTVLNIIGIVSVARANLLIIAIQAIFIVVFIVMAVAAVSGSGSVDVMAPFRGDGTADGMAPVLAGAAILCLSFLGFDAVSTLSEEARDARRDVPKAIMLATIICGVLFIILSYVSQLVFPSNAFTDVDSGSLDVMQSAGGAFLAAFFTAAYVAGASGSALTSQASVARILYAMGRDGVLPRKVFGHVSVKFGTPTWAVLVISIVSLLALVIDLAILASVVSFGALVAFSAVNLTVIKHYFVDAGEKNVVNNLVLPLIGFVLTVWLWTSLSAESLTIGLIWLAIGFLWLLGVTRGFRRPTPVLDLEELPAQPAK

SEQ ID NO: 67668 - protein, 424 aa, Pseudomonas fluorescens PfO-1
MQQEFNDPLWRTVLSGAQMLFVAFGALVLMPLITGLDPNVALFTAGLGTILFQIVTGRQVPVFLASSFAFITPIILAKGQFGLAATMGGVMAAGFVYTFLGLAVKIKGTGFIDRLLPPVVIGPVIISIGLAMAPIAANMAMGKAGDGSELIHYQTAMMISMPALLTTLIVAVFGKGIFRLVPIISGVLVGFAMSFYFGVVDTAKIAAAPWFALPHFTAPEFNWQAILFIVPVALAPAIEHIGGVIAVGSVTGRDYLKKPGLHRTLLGDGIATTAAGLFGGPPNTTYAEVTGAVMLTKNYNPKIMTWAAIFAISLAFIGKFGALLQSIPVPVMGGILCLLFGSIAAVGMNTLIRHKIDLGEARNLVIVSVTLVFGIGGVLVGTGTGPDDFGLKGIALCAVVAIALNLLLPGNDSWKQKKADEPLI

SEQ ID NO: 67669 - protein, 1566 aa, Ustilago maydis
MSAATPTSPGFPLTMGTGVMAAHFAAPSSNAGSPRSRPTTPLSAGLTPSGPTYDDLGRWDDADVASWLNAARLGHYASIFAEHDIRGSVILDVDQAALKEMGITMVKDRVRISAAIKLLNKRCADSAVARRPSVVSISPLLPLASHPLYAHEGEIEYLQHDHTADPSADGSGSNFGLNSMGMRRGQMRPPPLTLKQSTSRGMPGYASPAGSINQSQGFGLSAARGLTPGAARGSVWNTASSSSATSKPGTPDGALHRKVNSIGGVAAPLAVGASSSLSSSRHPYGHAVHSNRPSTATGASGYSNVPASQSLRSNHTSSSPTATSFGSNINAASARPSTATGAQSYTTNVPGTSSARDGYSPLTPISESNSLGNTPTTPSGIQQQQQSAGYAVGRGPFASSQRYAASSVPSQQQPSSGHTLRHVDSGEGYNLAGYQNPNPPTLEDLKRRTIKFISEEDNTTRIVNVSDCRDAYDVMARVLKKFGKPPSGNSYTPTADQGPTGDELGATETWGIFATSADGQNTKALSDNELLAICHAPQPHDPLRERGLTLRRIPNHLPGEDARKVPVRSGRNKLEAFFGERMPVAQMQPAGPGSGVNADEEDAGSVTISGKKMKRASTVSIMSGLGVGPFSSSSHNTGAGHTHGSTRAEGKLLSKKESKHMSPPPVTSKPSKIRNFFGQRPPSELINTNLADFFPSTDSKALQRTARRSIYGRASASTRSKRNSTWSFVADPDAPPLPNKGSMDGHPTPLERSSISIRERGTTPVIQIGYDSRSEDDHQSNARRTSSGTHSHLHPSLTGPPTLPPVVSRDSLDEWSRDLKAVGSPVTEENAMFQSSRHGHASGSQQHHAAMKHYPSHASGYADRPSISRRASGESARSRRSLASQVRHGLSAARERNADTASLLTVDEITQEVENRRESISLAGAGGGWVVDEDGVPIPIPGSSSPFSSSAAASTRPSSGISSSYVHNGHLEHDDSEGHSDEEANQSSDLEEATRTRKARGVPSKAASIRTVASKRASSVLQAPGDESDRHLGDPMAVARSTTSRASSVSELRRSVHDHGDPSDGESGSDFTDSDLDSDGSETDEDEQANDVYLPSAKPAPIKWHKGALIGAGSFGNVFLGMNAKTGLLMAVKQVELPSGDSHLDQRKKGMLEALEREIKLLKSLEHENIVQYLDSFADDSHLNIFLEYVPGGSIVALLRNYGAFEEPLVRNFVRQILNGLSFLHNRGIMHRDIKGANILVDNKGGIKISDFGISKKVESDLVLATNKGGAGGGGAGGAAHRPSLQGSVFWMAPEVVKQTSYTIKADIWSLGCLVVEMISGTHPWAELNQMQALFQIGMGRKPSLPDEISNECRDFLEKTFELDYNNRPSADELLNHAFMGTEMTFPPSSGADGSGGGDDDAGGSGDAGDGDASTMGMTNDAETGTTRETRETKDGKRPTRSKSTRRLEREKRHKEAAAAAAAATALDTGTPNTPTSHTAAAAAAAAAASASASASASPAVASTSPAPGDAETGSPTNGKSAVPPAGSTGGTPESILTVSIATARGNSTSTALSAADAAFSEEADS

SEQ ID NO: 67670 - protein, 148 aa, Oceanobacillus iheyensis HTE831
MEKTFLMVKPDGVQRELIGEIVKRFETKGYKLAGAKLMQVSNQLAETHYSEHKERPFFGELVDFITSGPVFAMVWEGENVIATARKMMGKTNPLEADPSTIRGDFGISVGKNIIHGSDSAESAEREITLFFTENEIVSYEKQANNWIY

SEQ ID NO: 67671 - protein, 323 aa, Oceanobacillus iheyensis HTE831
MKLPKIYGFLKKDMESIESALQDSIQANHPVLRDASTELLHAGGKRIRPVFVLLSSQLGNYDLSKIKKVAVTLELIHMATLVHDDVIDEAELRRGKPTTASIYGNRVAMYTGDYILARALEEITEIPDPRVHQLLSKTLVEVSIGEIEQIEYKFNWEQNFRDYLRRIKRKTALLIASSCKLGAIVGGLNDYQTNKLYQYGYYIGMSYQIIDDILDFTSTSKELGKPAGNDLLQGNITLPVLYAMEDKTFKQSLFNVFSKDGHVTTNEMKTLIQHLKRTDAIKRSYAVSDMYLSKALTALDEIPASRAKKTLQDIATYIGKRRS

SEQ ID NO: 67672 - protein, 340 aa, Oryza sativa (indica cultivar-group)
MAAAAPALPAFASLLLPSSSSPPRRIPWPRPLPSRRGALRPVKLLPAISAVEKGKGAAAEAKEVELEGMPPEYYDEEWQARQREKTKEWNAYRKKEEAEEERLTNEYREIGMRLKAYPQEEVRKARILVSSFIRAGEDIEEEIEKAAERGELTELVLMVIWNRLDVARRDRKIIIVECAENAFEKHDERDAIRSLDLLYRRVETEILRSEATPAMRLLNDLLNLHDGSDDDKWLKKCKKHMLEVFPREDPFTMVFPAGFNMEEHQGQIKLPPQDDDVLLRVDFIREVDELLKEVQAAHENNKVPTGNDPEAVATKLKYQEKLRTIRQVESLLELASSLKW

SEQ ID NO: 67673 - protein, 543 aa, Magnaporthe grisea 70-15
MSSTTEQAAAPHQTYDTILTLDFGSQYTHLITRRLRECNVYSEMLPCTTKLSDLTWKPKGIILSGGPYSVYDKDAPHADPAFFDLGVPVLGICYGLQELAWRLGKDNVVAGTEREYGHADLTPQKNSQAEKLFKGMGDDSLQVWMSHGDKLSQLPTGFQTIATTANSPFAAIAHESQNIFGVQFHPEVTHTRRGLDLLRNFAVGICGAQQNWNMHNFIEQEISRIRNLIGDKAQVIGAVSGGVDSTVAAKLMKEAIGDRFHAVLVDQGVMRHNECAEVKKALQDHLGINLTVADASERFLSGLKGVEDPEQKRKFIGNTFIDIFEEEAIKIEKAAENTPNAGKVEWFLQGTLYPDVIESISFKGPSATIKTHHNVGGLPKRMMEGQGLRLIEPLRELFKDEVRAMGRELKINEELVMRHPFPGPGIAIRILGEVTRERVEIARKADHVFISMIKEAGIYNEISQAYAALDTSRAVGVMGDKREYGYIVILRAVVTTDFMTATVYHMKPELLDRISTRIVNEVDGVTCVTYNITSKPPGTIEMQ

SEQ ID NO: 67674 - protein, 391 aa, Shewanella oneidensis MR-1
MSQFQSIDVADYYDAQTFKRIEEFAKDKATPFVVIDTSIIAKQYDDMVNSFPYADVYYAVKANPAAEILTLLKDKGSNFDIASIYELDMVMNVGVTADRVSYGNTIKKRQDVRAFYERGVRMYASDSEADLRMIAEEAPGSRIYVRILTEGTDTADWPLSRKFGCQNEMAYELLVLANELGLEPYGISFHVGSQQRDIGAWDSAIGKVKSIFDRLRDEHNIVLKMINMGGGFPANYIDKTNQLGVYAEQITHFLKEDFGDDLPQIILEPGRSLISNAGVLVSEVVLISKKSYTALERWVFTDVGKFSGLIETMDEAIKFPIFTHKQGELEKCVIAGPTCDSADIMYEHYSYGLPNDLAIGDRMYWLTAGAYTTTYSAVCFNGFPPLKDYYL

SEQ ID NO: 67675 - protein, 216 aa, Festuca arundinacea
MDAAVAVSLSLQSEEQEYRTVWSEPPKPRSERTKFQEARHPVYRGVRRRGRAGQWVCEMRIHGTKGSRLWLGTFDTAEMAARAHDAAALALSGGDACLNFADSAWRMQPVLPAGAESVCFGGAQEVKDAVAAAVEAFQEEEHHVASTAETAKDKESALSMSSDLSEHDDERWIDGMDAGSYYASLAQGMLVEPPDAGAWREDGEHGGVETSLWSYL

SEQ ID NO: 67676 - protein, 536 aa, Magnaporthe grisea 70-15
MASNPDPGVLSPQEAIHASTQATSTVAASTVAASTQAPSPDLPISQPQPQPQQPSPPLPTSPSQLEQAHAFAEPEVPPPLLPTPKSATFARSTQGGSSRRRRRSRSRNRAGTATSANNPYFPGDQASTRRLRYSIDEYEDEGLRNEIGRHPDGRSMPRARPPRAYLNHPAYANLDSPAKPYTEDPKGHREFDYEVDPNTRQQYEEEYAYGTGVSHGPGMAGPQPFMRFGPTSNASHYGPDSQAPRINWKDLSREERTEVLRLPWTQWMNSNVKNHFVAMLGELIGTTMFLFFAFAGVEVANIGLPSSAPFNLAKQLYISLSFGFSLMVNVWIFFRISGAQFNPAVTLALWMTGAVDAVRGVCLVISQLCGGMLASVIVRFLFPQRFSVRTSLSQNTSLVQGVFIEALLTSELVFTILMLAKEKHKATYMAPVGIGLALWIDHMVGVPFTGAGINPARSFGPCVVTATFEPEHWIYWVGPGIGALIAVAFYKLIKVLEYEMANPGADGDADNDPTQNPAKRAELAAGRRFAGGFDAK

SEQ ID NO: 67677 - protein, 335 aa, Triticum aestivum
  misc_feature (63)..(63): Xaa can be any naturally occurring amino acid
  unsure (1)..(335): unsure at all Xaa locations
MANLLSSAPTHATLPDCFVFPPDQRPPASSQAVSLPVIDLSRGRDEVRRAVLDAGKELGFFQXVVNHGVSPEAIRDMEAVCAEFFRLPAEDKVGFYSEDTDKPNRLFSSTTYELGGEKYWRDCLRLSCGSPVGDTKNNWPDKPQKLREVVEKFVGPTRGVGMELLRLLCEGMGLRPDYFEGDLTGGDVIINVNHYPPCPAPGLTLGLPPHCDRNLITFLLQSTVPGLQVSYKGDWINVESAVPNAFVVNFGHLLEIATNGVLKSIEHRAMTNAALARTSVATFIMPAADIPIGPAEELLGEGNPPRYRTVTFDEFMRVYKTVGARRESVEKAFKL

SEQ ID NO: 67678 - protein, 474 aa, Salmonella choleraesuis
MQYQLLINGVLVDGEGERQSVYNPATGEVILEIAEASPAQVDAAVLAADSAFAEWGQTTPKARAECLLKLADSIEQNALEFARLESQNCGKPLHCVINDEIPAIVDVFRFFAGAARCLSGLAAGEYLEGHTSMIRRDPIGVVASIAPWNYPLMMAAWKLAPALAAGNCVVIKPSEITPLTALKLAALAKDIFPPGVLNVLFGRGQTVGDVLTGHEKVRMVSLTGSIATGEHILRHTAPAIKRTHMELGGKAPVIVFDDADLDAAAQGVRTFGFYNAGQDCTAACRIYAQRGIYDALVEKLGNAVSSLKMGAPEDESTELGPLSSLAHLKRVTAAVEEAKALSHIRVITGGSQTEGKGYYFAPTLLADAKQEDAIVQREVFGPVVSITVFDDEDQVLRWANDSRYGLASSVWTQDVGRAHRLSARLQYGCTWINTHFMLVSEMPHGGQKQSGYGKDMSLYGLEDYTLVRHIMVKH

SEQ ID NO: 67679 - protein, 179 aa, Gluconobacter oxydans 621H
MSFQDPQPLDLKNYIREIPDFPKRGILFYDISTLIRSPDAWQVATARLARVIAAWQPDILAGIESRGFLTAAPLALRLGCGFTMLRKPGKLPGKTISLKYGLEYGEDELHIQADAIKPGQRVVVLDDLLATGGTLAASIDLLRKVGAEVVGASVLIELADLKGREKLDVPLNALMTYDE

SEQ ID NO: 67680 - protein, 497 aa, Spinacia oleracea
MSTVGRFMATMSNSLSLKHGVSLYSSTSSSFSLSKLHCKPSLVASRPFYNRRCFSISASSSFANDNREYVIVGGGNAAGYAARTFVEHGLADGKLCIVTKEAYAPYERPALTKGYLFPLDKKPARLPGFHTCVGGGGERQTPEWYQEKGIEMIYEDAVTGVDIEKHTLQTQSGKSLKYGSLIVATGCTATRFPEKIGGNLPGVHYVRDVADADSLIESLKKAKKVVIVGGGYIGMEVAAAAVGWNLDTTVIFPEDHLLQRLFTPSLARKYEELYEQNGVKFVKGAMIKNLEAGSDGSVAAVNLENGSTIEADTIIIGIGAKPAVGPFENVGLDTTVGGIEVDGLFRSKVPGIFAIGDVAAFPLKMYDRVARVEHVDHARKSAQHCVSALLSARTHTYDYLPYFYSRVFEYEGSQRKVWWQFFGDNVGEAVEVGNFDPKIATFWIDSGRLKGVLVESGSPEEFQLLPKIAKAQPLVDKAKLQSASSVEEALEIIHQSM

SEQ ID NO: 67681 - protein, 482 aa, Staphylococcus aureus subsp. aureus MRSA252
MGSFFNKIARKEDPAIYQNKDGHLKRTLRVRDFLALGVGTIVSTSIFTLPGIVAAEHAGPAVALSFLLAAIVAGLVAFTYAEMAAAMPFAGSAYSWVNVLFGEFFGWVAGWALLAEYFIAVAFVASGFSANLRGLVKPIGIELPAALSNPFGTNGGFIDIIAAIVILLTALLLSRGMSEAARMENILVILKVLAIILFVIVGLTAINVSNYVPFIPEHKVTATGDFGGWQGIYAGVSMIFLAYIGFDSIAANSAEALDPQKTMPRGILGSLSIAIVLFIAVALVLVGMFHYSQYANNAEPVGWALRQSGHGVVAAIVQAISVIGMFTALIGMMLAGSRLLYSFGRDGLLPSWLSHLNDKHLPNRALVILTIIGVLIGSMFPFAFLAQLISAGTLVAFMFVSLAMYRLRKREGKDLPIPAFKLPLYPVLPAVTFVLVLLVFWGLGFEAKLYTLIWFIVGIILYLSYGLRHSKKNDVAEYHPPK

SEQ ID NO: 67682 - protein, 320 aa, Sulfitobacter sp. EE-36
MTTPFLDTARRVIRTEAQALEQLADSLDDRFRQAIDLLVATRGRVIVTGIGKSGHIAKKIAATLASTGTPAQFVHPAEASHGDLGMITGDDVVLAISNSGEAPELANLIAYSRRFSIPLIGITSRAQSSLGAQCDVVLELPQLAEACGTGVVPSTSTTMTLAMGDAVAIALMENRAFTAEHFREFHPGGKLGARLSRVADLMHTGDALPLVQVDAPMSDALMAMSSKSFGVVIVTDSNGALAGIITSGDLGRHLEGLMSKTAREVMTPTPVTVAPDALAEKAVGIMNARKITCLLVLDPAQGDVPAGLLHIHDCLRVGLG

SEQ ID NO: 67683 - protein, 752 aa, Cryptococcus neoformans var. neoformans JEC21
MFNSSRDNTTEQEKNDDEIYTTELKGDESPSSSSSDIDEKNEKFDPYVDQSQEGIAVEEAKLDDFIHRDEKYDWDSEEFRNIPELVRNTVSFEDDPSMPVITFRAILLSTIFCAIGSVISQISYFRTTTAQFPVFFVILASHPLGKLLARVLPDYTVPLGRFSFSLNPGPFSVKEHVIIGIAANTGSQGQWATYLPTNAALYYNITMSPAIALFFGWGVSLLGFSFAAMVRPILIDDPQFIFPLSMQQVAVYRSIQGTSELHLERSRKQMRVSSFRYLKVFWWLFLGMFAWQFLPEFAFPFVASLAPLCWFASRNHKVNFLGAGRGGAGLLNITLDWSNITSTVITYPYSVQVIIFVSFCWILIPIAYFGNLWGSPTWNIMSNGVFMKNGTSYPFNSLCNMKRSALHTLELSTCGMSLWAWRAKKPAHNDRLSRIAAKYPGLTWWEWGLLTLIPFVILLAVVVSKKLYMSTWTYFVALGFGAAAMLPMSLVYAMSGYSMKVGIFNELIYGCKSRSSRHPLGQLAYRIISGNVWYDARTVLEDQKIGHYFHLPPRQVIGIQILANMLALPINYAVMRWVLDTKFDYVSGKEVDPTGQWTGQEFQSYNSAGVQYSLVGPKRLFRSSVYRPLTYGFVVGAAAPVIIWLLHKRFPRARFNLWNTTIFFSGAATFYGNLSTGPFTAFIIGTVWNFWLYRYRRKFWNMWAYISGAALDTGFNFNLLFIFIFLGTTGAVMPYWWGNNADSIERCFALNE

SEQ ID NO: 67684 - protein, 310 aa, Mannheimia succiniciproducens MBEL55E
MHMTNKIWVLGDAVVDLIPDGDNHYLRCAGGAPANVAVGVARLGVPSAFIGRVGKDPLGEFMRDTLNQENVNTDYMLLDPKQRTSTVVVGLTDGERSFTFMVNPSADQFLQISDLPQFQAGDWLHCCSIALINEPTRSATFTAMKNIRAAGGKVSFDPNLRESLWKSQDEMIDVVMEAVSLADVLKFSEEELTLLTHTDSLEKSFEKITALYPDKLIIVTLGKEGALYHLHGKKEVVAGKALKPVDTTGAGDAFVSGLLAGLSQTENWQQPEQLVTIIRQANASGALATTAKGAMSALPNQQQLAEFLAN

SEQ ID NO: 67685 - protein, 549 aa, Arabidopsis thaliana
  misc_feature (132)..(132): Xaa can be any naturally occurring amino acid
  unsure (1)..(549): unsure at all Xaa locations
MDFFHSREKRHGKRAGLFGHKSASKSNPSSPPHLAEGRSQPTTHFGMKRSESEYAFPISDEQTTHWKPQQQASERIPNSHQRPPVYRYSTPERPREPDEDVTPRSNGSGSPFRSARTRTVPNHFCSFFSICXFGTSNKVLSVSGVQPDRRKRSSEITKELYERMYEADANVSPFHPFRSRSPAPYNTHERGRDYSRERYEAEGNVTSRNRPSSPFHPSQSRSPPPHARLQTQRYNNGKDHFEGMYEADADITPRNSPPMSPVHQHTSYSPPPPFYSSSDDEDDNNSTYLFPEIATGRRSRGVSGSSTPVHYKYQITSVETYEQERQFEPPELPDESQSFTMQEIARMRGLQSYGKEEIQLAISETYVSVANYKVRMSIAATLEAIIDKHGDIAASSKLQSTSTRSFYLESLAAAVMELKSTALRDLTKTRVAEIAAVVKDMDSVKIDVSWLKTAVTELAEAVEYYGKYDTAKIVREECDREMTAGKKEMEEMREELRRREKETKECRERVTELAGRLGQLEMKDVRVKKNLELYESKVLKFDGHSVLVD

SEQ ID NO: 67686 - protein, 415 aa, Triticum aestivum
  misc_feature (174)..(174): Xaa can be any naturally occurring amino acid
  unsure (1)..(415): unsure at all Xaa locations
RCVERDEEKRPCISEIINELNKIDNGIINEPDKNYSDIVDEQDKLNVHLVDEVDKIDGYIVDEQGKIDPDIVDKQDKLSTAKTSTTNLIPADRLDSLFTPRCVWVNGPIIIGAGPSGLAVAASLREHAVPFVMLEREDCIASLCRKRTYDSLKVNHPKQFCELPGMPLPDHFPXYLTRAHFMDYLQQYTTKFNIKPNFNNTVLSARFDETSGLWRVCARGAETDGNAKMEYISRWLVVATGAEAVVPDIPGLAGFCGEVTHSSDYSSGISYIGKRVLVVGSGQSGMEVSVDLCNGGAVPFMVVRNVLGIATLYLTVLLMWWLPLWLVDKIMALLAWIVFADLTRLGVRTPSVNSLTLKKTDDYGRAWRATARKIRSGEITVVTSVRRFTKSGAELSDDSVVDVDAVILATGYRSN

SEQ ID NO: 67687 - protein, 701 aa, Ostreococcus tauri
MKSYPKKRWEPELRDKRSKITRTGGFTNAQGLNIRWYSWEVKKPKCAIVFAHGLGVYGSFEMLASVPPGTPRVHYSTSWPERMNARDASLFCIDHQGHGRSDSAVKGKRCYFHRLDDLVNDFRQFCELLRDDLGGDVPVFVVGSSLGGFVATKTMMESPKAANGLVTLAPMLSLDALSNRPINRVLIPIGDVLSALVPTVPIVKTHRNVKFPLTQKEVEDDALTWPSGVRNTRVRVASEAYKNTLKLKKPGTLERITCPVLAFHGRDDPMTDPRSSSMLYERVSSADKRLQWVDGVFHDLCHEKPSSDEICDEIIEWCLARISGPILPKAAKRARESDRGAESDATPTRQSAVLDADVERAAVETRYRRIRKTVQMPTRSITLVSALIALACLPRSSSAVKFGEDFTDTLKKKPAPMEGRTYARDFEGTQIFADDLSTAYMHGLTCGACMAVLNETKRIYDEIIETKFHHPDDVTGGAMYDYMHEATEPDEFCDGNALWEKYAVNNITGHVASAAWLRLRAVSQLRLHGQFEGTEMGKRAMASLNEYRWAIDLGLLGYDLFSLIEPDEERFDPIKLAETNDVEVPEEDEEYLQKTDTREFIVRSLKTHPYRIARQKMKLEQVCHDIVKSRAYIQSMLHRGLIRDLHYEICHSTKKCMWKTPHEVRQIEQARKLAVDAYLEALVDEGADAFGDEDGDEEEEL

SEQ ID NO: 67688 - protein, 336 aa, Shewanella sp. MR-4
MSKRTITVIPGDGIGPSIIDSALKILDKAGCDFEYEFADAGLTALEKQGELLPQRTLELIEKNRITLKGPLTTPVGEGFTSINVTLRKKFGLYANVRPVLSFKGTQARYENIDIITVRENTEGMYSGHGQKVSEDGTTAEATSIVTRQGAEQIATFAYELARKENRKKVTIVHKANIMKSTSGLFLKVAREVSQRYPDIKTEEMIVDATCMKLVMNPENFDVIVTTNLFGDILSDLCAGLVGGLGMAPGANIGRDAAIFEAVHGSAPDIAGKNLANPTSVILASIQMLEYLGMADKADMIRKAVSAVIEEGDRTTRDLGGTHGTTDFTQAVLDRLS

SEQ ID NO: 67689 - protein, 474 aa, Salmonella paratyphi
MQYQLLINGVLVDGEGERQSVYNPATGEVILEIAEASPAQIDAAVQAAVNTFAEWGQTTPKARAECLLKLADSIEQNALEFARLESQNCGKPLHCVINDEIPAIVDVFRFFAGAARCLSGLAAGEYLEGHTSMIRRDPIGVVASIAPWNYPLMMAAWKLAPALAAGNCVVIKPSEITPLTALKLAALAKDIFPPGVLNVLFGRGQTVGDVLTGHEKVRMVSLTGSIATGEHILRHTAPAIKRTHMELGGKAPVIVFDDADLDAVAQGVRTFGFYNAGQDCTAACRIYAQRGIYDALVEKLGNAVSSLKMGAPEDESTELGPLSSLAHLKRVTAAVEEAKALSHIRVITGGSQTEGKGYYFAPTLLADAKQEDAIVQREVFGPVVSITVFDDEDQVLRWGNDSRYGLASSVWTQDVGRAHRLSARLQYGCTWINTHFMLVSEMPHGGQKQSGYGKDMSLYGLEDYTLVRHIMVKH

SEQ ID NO: 67690 - protein, 474 aa, Salmonella typhi
MQYQLLINGVLVDGEGERQSVYNPATGEVILEIAEASPVQVDAAVLAADSAFAEWGQTTPKARAECLLKLADSIEQNALEFARLESQNCGKPLHCVINDEIPAIVDVFRFFAGAARCLSGLAAGEYLEGHTSMIRRDPIGVVASIAPWNYPLMMAAWKLAPALAAGNCVVIKPSEITPLTALKLAALAKDIFPPGVLNVLFGRGQTVGDVLTGHEKVRMVSLTGSIATGEHILRHTAPAIKRTHMELGGKAPVIVFDDADLDAVAQGVRTFGFYNAGQDCTAACRIYAQRGIYDALVEKLGNAVSSLKMGAPEDKSTELGPLSSLAHLKRVTAAVEEAKALSHIRVITGGSQTEGKGYYFAPTLLADAKQEDAIVQREVFGPVVSITVFDDEDQVLRWANDSRYGLASSVWTQDVGRAHRLSARLQYGCTWINTHFMLVSEMPHGGQKQSGYGKDMSLYGLEDYTLVRHIMVKH

SEQ ID NO: 67691 - protein, 474 aa, Salmonella typhimurium
MQYQLLINGVLVDGEGERQSVYNPATGEVILEIAEASPAQVDAAVQAADNAFAEWGQTTPKARAECLLKLADSIEQNALEFARLESQNCGKPLHCVINDEIPAIVDVFRFFAGAARCLSGLAAGEYLEGHTSMIRRDPIGVVASIAPWNYPLMMAAWKLAPALAAGNCVVIKPSEITPLTALKLAVLAKDIFPPGVLNVLFGRGQTVGDVLTGHEKVRMVSLTGSIATGEHILRHTAPAIKRTHMELGGKAPVIVFDDADLDAVAQGVRTFGFYNAGQDCTAACRIYAQRGIYDALVEKLGNAVSSLKMGAPEDESTELGPLSSLAHLKRVTAAVEEAKALSHIRVITGGSQTEGKGYYFAPTLLADAKQEDAIVQREVFGPVVSITVFDDEDQVLRWANDSRYGLASSVWTQDVGRAHRLSARLQYGCTWINTHFMLVSEMPHGGQKQSGYGKDMSLYGLEDYTLVRHIMVKH

SEQ ID NO: 67692 - protein, 252 aa, Salmonella enterica subsp. enterica serovar Typhi str. CT18
MKTVTVKNLIIGEGMPKIIVSLMGRDINSVKAEALAYREATFDILEWRVDHFMDIASTQSVLTAARVIRDAMPDIPLLFTFRSAKEGGEQTITTQHYLTLNRAAIDSGLVDMIDLELFTGDADVKATVDYAHAHNVYVVMSNHDFHQTPSAEEMVLRLRKMQALGADIPKIAVMPQSKHDVLTLLTATLEMQQHYADRPVITMSMAKEGVISRLAGEVFGSAATFGAVKQASAPGQIAVNDLRSVLMILHNA

SEQ ID NO: 67693 - protein, 503 aa, Ostreococcus tauri
MKRASSRLSRSLTAIARAPSARELAQRVELSVARASVASPSTRRSSATTLAWTRKAFFARSWSSDALPEHVIVPMPALSPTMTRGGIASWHVEVGQAIRAGDAIADVETDKATMAMEATEDGFMAAILVEAGAQDIEVGTPVCVTCENAEDVEAFKDYASTVAIKAESAAPVASAPSGPVESPSVAPVASAPSARATRAETRASGDRVFASPLAKRLAKERGVRLDNVRGTGPNGRVIAADVYEAHETGVNATEAAREVTVDHPLSKFFPDFEDVSVTAIKRVTAQRLTESKQQVPHFYLTVDVRLDNMISIRQTLNKQLADDKAAEGAKISVNDFIVKASAKALLAVPEVNSSWLGDKIRRYKKADISVAVQTERGLMVPIVRSACCLGLKTISSEVKALASRAREGSLTPQDMTGGTFTISNLGMFGVKSFAAIVNPPQAAILAVGGARKEVIKNESGGYEEITVMSATLSCDHRVVDGAVGAMWLQSFKGYIEDPMTMLL

SEQ ID NO: 67694 - protein, 801 aa, Bacillus cereus ATCC 14579
MKKRLVMIGNGMAGIRCMEEILKHDSDSYEITIFGDEPHPNYNRIMLSHVLQGKTNMQDIIMNEYSWYEENEITLYTNEKVQSINREEKIIITEKNRTLTYDKLIIATGSSAFILPVEGSTLPGVTGFRTIEDTQFMIDTANEKKKAVVIGGGLLGLEAARGLIDLGMDVHVVHLMPNLMEQQLDTKAASLLREDLEAQGMKFLMEKKTVKILGTDHVEGIQFEDGEVVDCDLIVMAVGIRPNTQIAKDAGLIVNRGIVVNDYMLTNDESIYAVGECAEHDGIAYGLVAPLYEQGAILAKHITNLQTDGYSGSIVGTQLKVAGCDLFSAGQIYEDDQTKAISIFDECKRSYKKVLIRDNKVVGIVLYGDTADGTRLFSMLKKEEDIQEYTPASLLHKAGEESEFDVATMSADDTICGCNGVTKGSIVHAILEQELTTFEEVKGCTKAAGSCGKCRPLVEQVLSHTLGDAFDASAQSAGMCGCTPLSRDEVVAAIHEKGLKSPKEVRNVLGFAHEDGCSKCRPALNYYLRMAIPEEYEDDKSSRFVNERMNGNIQHDGTFSVIPRMYGGVTTADDLMKIAEVAKKYDVPLVKITGASRIGLYGVKKQDLPNVWADLHMTSGYAYSKSLRNVKSCVGSRFCRFGTKDSLGLGMLLEQSLEMVDTPHKMKMGVTGCPRNCAEVLTKDFGVVCVENGYQLYIGGNGGTEVREADFVMIVPTEDDVLRIAAAYMQYYRETGIYGERTAYWTERLGFDHIKEILQDASMVTTLNERFQTARRTYTEAWGQALETKSLKAMYEVETVK

SEQ ID NO: 67695 - protein, 532 aa, Oryza sativa
MDVRRGGGGGRIVGAARRALTWGALPLPMRITNGLAMVSLVLSSCDLLRLCSDRERPLGGREFATVVYLVSLFAHPDAPATTTGDDDDGQGGSRRARPAAAEPAPMHGHGGGMMEADDEEIVAAVASGALPSHRLESRLGDCRRAARLRREALRRVTGRGVEGLPFDGMDYQAILGQCCEMPVGYVQLPVGVAGPLLLDGREYHVPMATTEGCLVASVNRGCRAISASGGAFSVLLRDAMSRAPAVKLPSAMRAAELKAFAEAPANFELLAAVFNMSSRFGRLQDIRCALAGRNLYMRFSCITGDAMGMNMVSKGVENVLGYLQNVFPDMDVISVSGNYCSDKKPTAVNWIEGRGKSVVCEAIIKGDVVQKVLKTTVEKLVELNIIKNLAGSAVAGALGGFNAHASNIVTALFIATGQDPAQNVESSQCITMLEEVNDGDDLHISVTMPSIEVGTIGGGTCLASQAACLNLLGVKGSNHGSPGANAKRLATIVAGSVLAGELSLLAALASGHLVKSHMMYNRSSKDVAKAAS

SEQ ID NO: 67696 - protein, 1039 aa, Magnaporthe grisea 70-15
MPRLRSKAYLTCFYCGRKTSTRNDGSVRRFECPSCEATNYLDENGEITDPPLEATAPSGATDDKPPTMRDLLASQPDNDVFCAECLKNQRLFTASLAQYLPGDPDDPEYEARERNFYKFRNNLDRQYPQTCSKCEPKVLERIAQAGYTAKTDHLRRMIDRSLKARTAEQASATGPLGVLSAVGRYLWLAGFIMQGLWHFRMMHELAKTADFPWLRSFGVRQLLGVLASLLSLLPEPEKVMKWSILSTAVSLWWNPFFLKTLTMHSLACIVMFYIAKLALSSIRVDTTPLFGSKSLPTPKSPEAAPQPSQRKSSGDTMFDMLDEVLVSPVPARESDDETETQSLPPKIRPRFTEGPLRGQQMSQGGGLFAPENARGSTFGRQDDKLRTTEYASEMDWQPTELPPRAFNPFSAPEQPLRSFNDAPVNDKHGPFWFKVPPAPATSMAHRALSPSTASSTALLQSQPEPIQQRRFFASREEEARKEQEVREERMRKEKERTKYIKSPSFRYRANDPRDPLSDMFEDTFKISPTRAASAQQAAQKADSAKEEVAARQIKASDFSVLLLSALLLIPGYETFVPKEYGVHMALSTLQVQGRHRSKAFAYTVAAALALSEVGFITWTGLKAQDSVFNLGNSADCLKLVKVADVKTLHVGTGTIFRVLGNPSLAFGWHSSEFCQGIESSQVVGYLCSSIWGLPGANLFTWYAWPAFQGLTSFFSCKWPNFGPIKNRSLENRRSARSSIEPGEQAKPDFESQTQSKRNSIMEIESTQELEDCVGSTTSIQSGCKLQKSLSMPALYASPYVWLDPMEPSSWGKDGYLKVMTGTGTAVKGTDFLQQLEAGLPGDSQKTSRPVNFGMIVPGVYRSGYPQQEHHAFMKDLKLKTVVTLVEKEPPEGFKPFLTSNNIKHHIIAMKGTKKESISLGTMQSILNVVLNPKNHPLLVHCNHGKHRTGCVAGVVRKVTGWETDAIIDEYRKFADPKERECDIDYITMFDIADAKLSSMFARKPLYAQVGPIGMVMLTILVLALFTLTMIKDNVATDWS

SEQ ID NO: 67697 - protein, 331 aa, Shewanella sp. MR-4
MISNQIHLASRPTGMPTQTNFKLVEVTLPALKTGEVLVKNTWMSVDPYMRGRMIDKDSYIPPYQINEVMDGGAIGEVIESLNPQFPVGAKVSHISGWRSAFISDGSDLTLLPAVNIPEQYFLGIIGMPGLTAWVGLMKVAKLKPTDTVFVSAASGAVGMVVCQIAKLNGCKVIASVGSDEKAELVKSLGVDAVINYKNVTDLTQALRDAAPEGIDVYFENVGGAHLEAALDVMNDYGRISVCGMIAYYNAQTPVPGPSNLLAINTKKLTMQGFIVMDYWDQYSEFVGQMAQWLQEGKMKSEETVYQGLEQAPDAFIGLFEGKNKGKMLVKL

SEQ ID NO: 67698 - protein, 212 aa, Marinobacter sp. ELB17
MTHCLRIGVGGPVGSGKTALLRQLCNALKDHYDIAVVTNDIYTREDADFLLKHDALPADRILGVETGGCPHTAIREDASMNLAAIDDLQNRHPNLELVLVESGGDNLSATFSPELSDLTLYVIDVSAGDKIPRKGGPGITKSDLLIINKIDIAEYVHASLDIMERDSKMMRGERPFVFANLYDGVGLETIISFILERGMLPERRPVKLAETA

SEQ ID NO: 67699 - protein, 117 aa, Marinobacter sp. ELB17
MYPREIKWCEECEECLSLVFFPKLELVLVESGGDKIPRKCGLSITKSDLLIINKIDIAEYVHASLNIMDCDSKMMRGEWPFVFANLYNGVGLEMIISFILERGMLPERRPEKLAETA

SEQ ID NO: 67700 - protein, 385 aa, Sulfitobacter sp. EE-36
MAKRDYYETLGVAKGASADEIKKGYRTKAKELHPDRNADNPNAEAQFKEANEAYEVLKDPEKKAAYDRYGHAAFEGGMGGGGGHRGGGFGGGGQGDFSSAFSDVFDDLFGDFMGGQRGGGGRRAARGADLRYNLGITLEDAYRGMQKSINVPTSVACDSCNGSGSEGGAEPTTCPTCSGMGKVRAQQGFFTVERTCPTCSGMGQIVKNPCKSCRGAGRVEKDRALSVNIPAGVETGTRIRLAGEGEAGMRGGPSGDLYIFIEVQDHKLFERDGPNLFCRVPVSMSTAALGGSIEVPTIDGGRGRVQIPAGSQSGRQMRLRGKGMPPLRGGGTGDMIIELAVETPVNLTSRQKELLQEFEKESSNNNPESSSFFSSVKSFWDSMKG

SEQ ID NO: 67701 - protein, 426 aa, Oceanobacillus iheyensis HTE831
MVADKAADSSNVNQENMDVLNTTQTIIKSALDKLGYPEEVFELLKEPMRILTVRIPVRMDDGNVKVFTGYRAQHNDAVGPTKGGIRFHPNVTETEVKALSIWMSLKSGIVDLPYGGAKGGIICDPREMSFRELEALSRGYVRAVSQIVGPTKDIPAPDVFTNSQIMAWMMDEYSKIDEFNNPGFITGKPIVLGGSHGRESATAKGVTIVLNEAAKKKGIDIKGARVVIQGFGNAGSFLAKFLHDAGAKVVAISDAYGALYDPEGLDIDYLLDRRDSFGTVTKLFNNTISNDALFELDCDIIVPAAVENQITRENAHNIKASIVVEAANGPTTMEATKILTERDILIVPDVLASAGGVTVSYFEWVQNNQGFYWSEEEIDNKLHEIMIKSFNNIYNMSKTRRIDMRLAAYMVGVRKMAEASRFRGWV

SEQ ID NO: 67702 - protein, 977 aa, Oryza sativa
MTPLLLLLLALAAGAGAASFPADFANLFAAKAALSDPSSALAGWDPGLSPSLSPCRWPHLLCSNPSSSSSAAIAAVLLSNLSLAGEFPAPLCELRSLALLDLSYNDLTGPLPGCLAAMPSLRHLDLAGNGFSGEVPRSYGAGFPSLLTLSLAGNELSGELPAFLANVSALEELLLAYNQFAPSPLPETFTGIRRLQVLWLAGCNLVGDIPPSIGSLKSLVNLDLSTNNLTGEIPSSIGGLESVVQLELYSNQLTGSLPEGMSALKKLRFFDAAMNQLSGEIPADLFLAPRLESLHLYQNELTGRVPATVADAAALNDLRLFTNRLVGELPPEFGKKSPLEFLDLSDNRISGEIPATLCSAGKLEQLLMLNNELVGPIPAELGQCRTLTRVRLPNNRLSGAVPPDMWGLPHLYLLELAGNALSGAVAPAIATARNLSQLLISDNRFAGALPPELGSLPNLFELSASNNVFSGPLPASLTVVTTLGRLDLRNNSLSGELPRGVRRWQKLTQLDLADNRLTGNIPAELGDLPVLNSLDLSNNELTGGVPVQLENLKLSLLNLSNNRLAGVLPPLFAGEMYKDSFLGNPGLCTGGSCSSGRRARAGRRGLVGSVTVAVAGVILLLGAAWFAHRYRSQRRWSTEDAAGEKSRWVVTSFHKAEFDEEDILSCLDDEDNVVGTGAAGKVYKAVLGNGARGGDDGAVVAVKKLWANGGAAKKAAAMEAGGGGGGGGKDTFEAEVATLGRIRHKNIVKLWCSLSSGDRRLLVYEYMPNGSLGDLLHGGKGGLLDWPARHRIMVDAAEGLSYLHHDCAPPIVHRDVKSNNILLDADLRAKVADFGVARAVSAAPPTAVSAIAGSCGYIAPEYSYTLRITEKSDVYSFGVVMLELLTGKAPAGPELGEKDLVRWVCGCVERDGVDRVLDARLAGAPRDETRRALNVALLCASSLPINRPSMRSVVKLLLELRPESKEKAMAEEKPLLV

SEQ ID NO: 67703 - protein, 478 aa, Mycobacterium sp. MCS
MREYLKFYIDGQWVDPLRPNALEVDNPTTEEVSGKIAMGSSADVDLAVSAARRAFATWSQTTREERLDVLQAILAEYQKRTDDLADAVTEEMGAPPSLSAGPQVNLGLGHLMTAIDVLKNYEFEEQHGSTLVVKEPVGVCGLITPWNWPINQIACKVFPALATGCTMVLKPSEVAPYSAQIFTEIVDAAGVPAGVYNLVFGDGPGVGVPLSSHPDVDMVSFTGSTRAGIEVARNAAPTVKRVTQELGGKSPNIVLDDDDFAKSVTAGVSVMMMNSGQSCNAPSRMLVPSSRMDEAIEIARQTAGAVKVGDPGDKTAIGPVASKAQFDKIQGLIQKGIDEGATVAVGGTGRPDGLDKGYYVKPTVFANVTNDMTIAREEIFGPVLCILGYDDLDQAIEIANDTEYGLAGYVSAADLDKAREVARRIRAGSVAINHGFDMNAPFGGYKRSGNGREWGQFAFDEFLEIKAALGYAPEAAAK

SEQ ID NO: 67704 - protein, 1346 aa, Burkholderia vietnamiensis G4
MGATGRVIRLHLFIACRRISRILSHHMAGPAPAHEPTMASTTLGVKVDDLLRSRLKDAATRLERTPHWLIKQAIFAYLERIEHGQLPPELSGSSGVTELADGHAAEDDDNSPHPFLEFAQNVQPQSVLRAAITAAYRRPEPECVPFLLGQARLPANLQADVQTLATHLVETLREKSSGGGVEGLIHEFSLSSQEGVALMCLAEALLRIPDRATRDALIRDKISKGDWRSHVGHAPSLFVNAATWGLMITGKLVTTNSEAGLSSALTRLIGRGGEPLIRKGVDMAMRLMGEQFVTGETISEALANSRKYEARGFRYSYDMLGEAATTEEDALRYYASYEQAIHAIGKAAGGRGIYEGPGISIKLSALHARYSRSQQDRTMSELLPRVRALALLARRYDIGLNIDAEEADRLELSLDLLEALCFDPDLAGWNGIGFVVQGYQKRCPFVIDYLIDLARRSRHRLMIRLVKGAYWDSEIKRAQVDGLEGYPVYTRKIYTDVSYLACAKKLLAAPDAVYPQFATHNAYTLAAIYHLAGQNYYPGQYEFQCLHGMGEPLYEEVTGRDKLNRPCRVYAPVGTHETLLAYLVRRLLENGANTSFVNRIADKTVSVKELVADPVDEASKVVPLGAPHAKIPLPRNLYGDERANSMGLDLSNEHRLASLSSALLASAHHPWRAAPMLADDALADAPARDVRNPADQRDVVGAVSEATSEHVSAALAHAVAAAPIWQATPVDARADCLVRAADLLEAQMHTLMGLIVREAGKSLPNAIAEIREAVDFLRYYAAQIRGEFSNDTHRPLGPVVCISPWNFPLAIFMGQVAAALAAGNTVLAKPAEQTPLIAAQAVRLLREAGVPAGAVQLLPGTGETVGAALVADPRTRAVMFTGSTEVARLINKTLSARLDPDGKPIPLIAETGGQNAMIVDSSALAEQVVADVMQSSFDSAGQRCSALRVLCLQDDVADRTLTMLKGAMHELALGNPDRLSTDVGPVIDAEAKQTIDTHVAAMKDKGHAVTQLPMPDACAHGTFVPPTLIEIGSIDELKREVFGPVLHVVRYRRSQLDKLLEQIRATGYGLTLGIHTRIDETIAHVIANAHVGNIYVNRNVIGAVVGVQPFGGEGLSGTGPKAGGALYLQRLLATRPSGLPKALAQTLIADGVAEGEQRGNPAAALTALRDWLIEQREPALAARCDGYLSQVPAGATAVLTGPTGERNTYTLGPRGTVLCVAATPSGARAQFAAVLATGNRALFAGSAGEALVAALPAALKGHAAVRKQADAPFDAVLFEGDSDELQTLVKDVAQRPGPIVSVQGVSAGAFENGDAEDYALERLLTERSVSVNTAAAGGNANLMTIG

SEQ ID NO: 67705 - protein, 359 aa, Triticum aestivum
  misc_feature (324)..(324): Xaa can be any naturally occurring amino acid
  misc_feature (335)..(335): Xaa can be any naturally occurring amino acid
  unsure (1)..(359): unsure at all Xaa locations
MSAYCGKYKDELIKNAAYIGTPGKGILAADESTGTIGKRFASINVENVEDNRRALRELLFCTPGALQYLSGVILFEETLYQSTKGGKPFVDILKEGNVLPGIKVDKGTVELAGTNGETTTQGFDDLGKRCAKYYEAGARFAKWRAVLKIGLTEPSQLSIDQNAQGLARYAIICQENGLVPIVEPEILVDGPHDIDRCAYVTEMVLAACYKALNDQHVLLEGTLLKPNMVTPGSDAKKVAPEVIAEYTVRTLQRTVPAAVPAIVFLSGGQSEEEATLNLNAMNKLQTKKPWNLSFSFGRALQQSTLKAWAGKAENEEKARKAFLXRCKANSEATLXGTYKGDATLGEGASESLHVKDYKY

SEQ ID NO: 67706 - protein, 587 aa, Candidatus Kuenenia stuttgartiensis
MSLDPTKFADWQIAEEAEKGMKTVYELADKLGLAKEELLPHGHYVAKVDYKKILKRYEGKPDGKFVDVTAITPTPLGEGKSTTTIGLVQGLGKRGKNVIGTIRQPSGGPTMNIKGSAAGGGLSQCIPLTPFSLGLTGDINAIMNAHNLAMVALTSRMQHEFNYDDATLAKKNLRRLNIDPHRVEMKWIIDFCAQSLRQIVIGLGGKMDGFMMESGFAIAVSSEIMAILSVAKDLKDMRERMGKIVVAYDKSGKPVTTADLEVDGAMTAWMVEALNPNLMQTIEGQPVFVHAGPFANIAIGQSSIVADRIALKLGDYVVTESGFGADIGFEKFWNLKCRFSGSKPNAAVLVATVRALKCHGGAPVPVPGHPLDPCYKEENVGWVEKGTENLTHLINVVKKAGINPVVCINAFYTDTEPEINAVRRLAERAGARVALSKHWLKGGDGAVELADAVIDACNEPNDFKFLYELSTPLRTRIELIAEQVYGADGVDYSPDALAKVKAMEADPETSKLGTCMVKTHLSLTDNPNIKGAPKNWRLSIRDILTFKGAGFVVPIAGNIKLMPGTCSDPAYRRVDVDVETGKVKGLF

SEQ ID NO: 67707 - protein, 298 aa, Saccharomyces cerevisiae
MSTNAKESAGKNIKYPWWYGGAAGIFATMVTHPLDLAKVRLQAAPMPKPTLFRMLESILANEGVVGLYSGLSAAVLRQCTYTTVRFGAYDLLKENVIPREQLTNMAYLLPCSMFSGAIGGLAGNFADVVNIRMQNDSALEAAKRRNYKNAIDGVYKIYRYEGGLKTLFTGWKPNMVRGILMTASQVVTYDVFKNYLVTKLDFDASKNYTHLTASLLAGLVATTVCSPADVMKTRIMNGSGDHQPALKILADAVRKEGPSFMFRGWLPSFTRLGPFTMLIFFAIEQLKKHRVGMPKEDK

SEQ ID NO: 67708 - protein, 335 aa, Saccharomyces cerevisiae
MSEPAQKKQKVANNSLEQLKASGTVVVADTGDFGSIAKFQPQDSTTNPSLILAAAKQPTYAKLIDVAVEYGKKHGKTTEEQVENAVDRLLVEFGKEILKIVPGRVSTEVDARLSFDTQATIEKARHIIKLFEQEGVSKERVLIKIASTWEGIQAAKELEEKDGIHCNLTLLFSFVQAVACAEAQVTLISPFVGRILDWYKSSTGKDYKGEADPGVISVKKIYNYYKKYGYKTIVMGASFRSTDEIKNLAGVDYLTISPALLDKLMNSTEPFPRVLDPVSAKKEAGDKISYISDESKFRFDLNEDAMATEKLSEGIRKFSADIVTLFDLIEKKVTA

SEQ ID NO: 67709 - protein, 380 aa, Gluconobacter oxydans 621H
MATRIDYYESLEVSRTASQDELKKAFRKQAMRYHPDRNPGDDAAEQKFKEINEAYDVLKDEQKRAAYDRYGHDAFEGGMGGMGGGFGGGFAGAGGLGDIFDQMFGDMMGGRRDGGRRTGADVQVQVEITLMEAFTGVTKDVEVRTRVTCEACHGSGSADPKAGSSTCPTCHGAGKVRAQQGFFLVERPCPTCHGSGRTVANPCKVCHGTGTEAKTETISIDIPAGVEDGTRIRMAGKGEAGGEGVQPGDLYVHISVLSHDIFQRDGANIYCRVPLRMTQAALGTEVEVPVVDGGRSKVRIPAGTQTGETFRLRGKGFSVLRSSARGDMYIQVSVETPSHLTKRQRELLEEFEKEAGDDHAKGSPENSGFFAKVRDFFEGR

SEQ ID NO: 67710 - protein, 245 aa, Aspergillus nidulans FGSC A4
MISDKAVLHRLPSMLTFCRLFLPNSITTKVMSTNKSAYGTPTPDTFGGKSWDREEYAKKGAEEEAKRREEGKARYEAKLLGKKWHAPVDYSSLEATTSRKERLDVASMVGKTTIVSAANAVGKRGRGAGFYCSDCDLTFKDNLQLVEHLNSKQHLIATGQSGEVAKATVEDVRQRLRMLAHQKRVREEEERMVWQMDLGERLKEREEQLSKEREEKRRKRNEKRRKGGDGVKQEDSWEGRLGIIA

SEQ ID NO: 67711 - protein, 282 aa, Gluconobacter oxydans 621H
MSQQNFRSILTGSFSTPCDDNPTVAMIEAAYRHHDIDARYINCDVKADGLKDAVAGARAMEWVGFNCSLPHKVAVIEHLDELAESARIIGAVNCVSIRDGRLIGDNTDGKGFLASLNKVGDPSGKKVLLLGAGGAARAIAVELGLVSAAHIMVMNRDPKKAETIAALVRDNTSAKADVQAWDGEASVPEDVDILINATSIGLGDADAMPPLKVETLRKGLIVADVIPNPPAAGSRKQGLHRAGRARDAGQSGRDRRGALAGQDVGRRGDGADPEGYFRRGLT

SEQ ID NO: 67712 - protein, 315 aa, Betula pendula
MENFPVINMEKLNGDERGATMAKINDACENWGFFELVNHSIPHEFLDNLERLAKEHYKKCLEQRFKEMVASKALEGAKAEVNDMDWESTFHVRHLPQSNISEIPDLEDEYRNVLKEFALKLEKLAEELLDLLCENLGLEKGYLKNAFYGSNGPTFGTKVSNYPPCPKPDLIKGLRAHTDAGGIILLFQDDKVSGLQLLKDGQWIDVPPMRHSIVINLGDQLEVITNGKYKSILHRVIAQTDGNRMSIASFYNPGSDAVIYPAPSMVEKETEEKNVYPKFVFEDYMKLYAGLKFQAKEPRFEAMKANGKLGPIATA

SEQ ID NO: 67713 - protein, 68 aa, Triticum aestivum
HYRTSLYKKAGWYRSGIPGISSTHASDSEKVEIKWGNHALSNMVQEAVEVIVDFVNREGPKGWDDPWS

SEQ ID NO: 67714 - protein, 236 aa, Oryza sativa
  misc_feature (207)..(207): Xaa can be any naturally occurring amino acid
  misc_feature (224)..(225): Xaa can be any naturally occurring amino acid
  unsure (1)..(236): unsure at all Xaa locations
RPAGEKKKKKKKKNSPLWRKRKKISRLLRSLRRQDESRLNRGGAAISIWRAEQARGLCEKKCIKSQEYASEHGLPILKNVLLPKTKGFLCCLQELKSSLDAVYDVTIAYKHRLPDFLDIIYGTDPSEVHIHIRTVKLCDIPTSEDEVTDWMIERFRQKDQLLSDFFMQGHFPDEGTEGDVSTPECLANFIAIVSSTGFFLYLSLFSXSVWVKVYVLLSCAYLTXXTYFSHSPPQLI

SEQ ID NO: 67715 - protein, 211 aa, Magnaporthe grisea 70-15
MSEKGKAVASAAGDDTTTPSNPRGIPKAPFVDNVEDYVTSRAEVESTLVRFQEMISKYQFMELNLQRRVAGLKGKLPDIEKTLETVQFLKLSKDGGDPIETSFELNDTLYTKAEIPPTDEVFLWLGANVMLSYPIDEAEELLDSKQKAAKQSLQNCEEDLEFLREQITTMEVALARVYNWDVMQKRKEKAEEDKLKGKDKEKETSKPDNDS

SEQ ID NO: 67716 - protein, 447 aa, Oryza sativa
MPIGVLLIRVTSNVKSTRSIRILFYCHVASQIVAVILATAGAVLSISNFENAFNNTHQRIGLALYGFIWLQPLIGFLRPDRGVRFRSIWYLTHWLLGIAICVVGVANVYIGMHTYHERTGRSVRPWTVLLTVEVSAMAFVYLFQDRWNHVVRQQQQQEAAALGDDDDDDDEQSEEHVYPANDHKEVAVVPDGSHGGGGGSWVGEDGRVWHSHDGLAPHSHEPIYSPGDFSKRAPPLISRRFAERAFTVGIGGPVGTGKTALMLALCRSLREKYSLAAVTNDIFTKEDGEFLIKHGALPEERIRAVETGGCPHAAIREDISINLGPLEELSNLCKADLLLCESGGDNLAANFSRELADYIIYIIDVSGGDKIPRKGGPGITQADLLIINKTDLAPAVGADLAVMERDALRMREGGPFVFAQVKHGVGVEEIVNHILQAWEIATGNKRR

SEQ ID NO: 67717 - protein, 324 aa, Bacteroides thetaiotaomicron VPI-5482
MDSISLIKTPIEAELEDFKALFDTPLSDSNALLDSVITHIRKRNGKMMRPILVLLVARLYGAVTPATLHAAVSLELLHTASLVHDDVVDESTERRGQLSVNAIFNNKVSVLAGDYLLATSLVHAEQTNNYEIIRLVSSLGQKLAEGELLQLSNVSNHSFSEEVYFDVIRKKTAALFAACAEAAALSVQVGEEEVAFARLLGEYIGICFQIKDDIFDYFDSKKIGKPTGNDMLEGKLTLPALYALNTTKDAWAEQIAFKVKEGTATPDEIVRLIEFTKDNGGIEYACRTIEQYKKKAFDLLAALPDSNICLALRTYLDYVVAREK

SEQ ID NO: 67718 - protein, 278 aa, Glycine max
MLYIIGLGLGDEQDITLKGLEAVKKCSKVYMEAYTSLLSFGLSTNGISNLEKLYGKPIILADREMVEEKADEILSEADHAHVAFLVVGDPFGATTHTDLVVRAKKMAIEVKVVHNASVMNAIGVCGLQLYRYGETVSIPFFTETWRPDSFYEKIQRNLSMGLHTLCLLDIRVKEPTLESLCRGRKAYEPPRYMTINTAIEQLLEIVQAREEPAYTEDTECVGLARLGSEDQMIVAGTMKQLQMVDFGAPLHCLVITGQTHPVEEEMLYFYRCRTSIQH

SEQ ID NO: 67719 - protein, 176 aa, Bacteroides thetaiotaomicron VPI-5482
MIMSKETLIKSIREIPDFPIPGILFYDVTTLFKDPWCLQELSNIMFEMYKDKGITKVVGIESRGFIMGPILATRLNAGFIPIRKPGKLPAEVIEESYDKEYGTDTVQIHKDALDENDVVLLHDDLLATGGTMKAACELVKKLKPKKVYVNFIIELKDLNGKSVFGDDVEVESVLTL

SEQ ID NO: 67720 - protein, 346 aa, Burkholderia mallei ATCC 23344
MKALVYHGPGRKSLDERPMPELAAPTDVIVRVTRTTICGTDLHILKGDVPSCEPGRVLGHEGVGVVHRAGGAVSTFKEGDRVLISCISSCGQCEYCRRGMYSHCATGGWILGNRIDGTQAEYVRIPHAQTSLYRIAPGADEEALVMLSDILPTGFECGVLNGRVQPGGTVAIIGAGPIGLAALLTAQFYSPAQIVMIDPDPNRLALARRFGATACIDNGQVDAVAGVKALTGDGVDCAIEAVGIPASFELCQRIIAPGGVIANVGVHGMKADLHLETLWDRNITITTRLVDTSSTPMLLKTVGAGRLDPKQLITHRFSLADIGQAYETFGHAAHTRALKVIVEVSE

SEQ ID NO: 67721 - protein, 327 aa, Arabidopsis thaliana
MNEVAIKRINRSICNGGVGFGVRKVFGKGSFGSVRLFSYKRRCDGETLYATVKTSDDAKSLYEEFQILSKFKGCPRIVQCYGNGVKQRFNDKGYVEYMIPMEYATGGSLNNFMDRFNDRKLPDPMIRKFTRMLLEGLATIHRYGYVHYDIKPENILVFPGSVYKEGAWRYSYKLKISDFGLSKRDGDTKWWHPLKSYAGTRIYMSPESISHGEIGKGLDLWSLGCVVLEMYTGKRPWWHTNYELEDLMKCYEPLFPPNLPCDAKLFLMTCFAPEPDERKDALTLLRQSFFRRDVNKLTKLLKVDNRNDFTLELKKLRQMLSEIRSMR

SEQ ID NO: 67722 - protein, 404 aa, Geobacillus kaustophilus HTA426
MRKPNVVILGAGYGGLMTTVRLQKLIGVNEANITLVNKHDYHYETTWLHEASAGTLHHDRVRYPISDVIDRNKVKFIQDTVTKIIPNEKKVLLENGELTYDYLVIALGFESETFGIKGLKEYAFSIANVDAARQIREHIEYQFATYNAEEEKKEERLTIVVGGAGFTGIEFLGELANRMPELCREYDIDPHKVRIICVEAAPTALPGFDPELVEYAVSQLERKGVEFRIGTAIKECTPDGIIVAKGDDVEEIKAGTVIWAAGVRGSRVIEESGFEAARARIKVDPYLRVPGHEDIFVVGDCSLVIDEETNRPYPPTAQIAMQEGQLCAKNLAVLIRGQGELEPFKPDIKGTVCSLGHDDAIGVVFGKKLWGAKASFMKKVIDNRALYLIGGSSLVMKKGKFKFF

SEQ ID NO: 67723 - protein, 117 aa, Triticum aestivum
MAQEAKDASESILILYRVLEDPSSSSDAVRTKEVAITNLTNYLTKEMIELPIEHVEKKLSQMILDKKFAGTLDQGAGCLIIFEDAKTEAIFPATLETISNVGKVVESLYMRSAKIMA

SEQ ID NO: 67724 - protein, 168 aa, Oryza sativa (japonica cultivar-group)
MAATAAASVAAISPLPGASLPRPVSARVPLLPRASPPTWRLSVGSARARSTRCLAAAGGGGLAPEMRATLDKVVGSHKVVLFMKGTKDFPQCGFSHTVVQILRSLDVPFETLDVLANEALRQGLKEYSSWPTFPQLYIDGEFFGGCDITVDAYKSGELQETLEKAMLS

SEQ ID NO: 67725 - protein, 356 aa, Ralstonia solanacearum
MTKIAVLPGDGIGTEIVAEAVKVLKTLGETFEMETAPVGGAGYEAKGHPLPEDTLKLAKEADAILFGAVGDWKYDTLPRELRPEQAILGLRKHLQLFANFRPAICYPELAGASSMKPEIVAGLDILIVRELTGDIYFGQPRGVRAAPDGLFAGAREGFDTMRYSEPEIRRIAHVAFQAAAKRGKKLCSVDKANVLETFQFWKDIVTDVHKEYPEVELSHMYVDNAAMQLVKAPKNFDVVVTGNMFGDILSDEAAMLTGSIGMLPSASLDANNKGLYEPSHGSAPDIAGKGIANPLATILSAAMMLRYTLGKAEQADRIENAVKKVLAQGYRTGDILTPGCKQVGTVEMGDAVVAAL

SEQ ID NO: 67726 - protein, 717 aa, Saccharomyces cerevisiae
MEQTQTAEGTDLLIGDEKTNDLPFVQLFLEEIGCTQYLDSFIQCNLVTEEEIKYLDKDILIALGVNKIGDRLKILRKSKSFQRDKRIEQVNRLKNLMEKVSSLSTATLSMNSELIPEKHCVIFILNDGSAKKVNVNGCFNADSIKKRLIRRLPHELLATNSNGEVTKMVQDYDVFVLDYTKNVLHLLYDVELVTICHANDRVEKNRLIFVSKDQTPSDKAISTSKKLYLRTLSALSQVGPSSSNLLAQNKGISHNNAEGKLRIDNTEKDRIRQIFNQRPPSEFISTNLAGYFPHTDMKRLQKTMRESFRHSARLSIAQRRPLSAESNNIGDILLKHSNAVDMALLQGLDQTRLSSKLDTTKIPKLAHKRPEDNDAISNQLELLSVESGEEEDHDFFGEDSDIVSLPTKIATPKNWLKGACIGSGSFGSVYLGMNAHTGELMAVKQVEIKNNNIGVPTDNNKQANSDENNEQEEQQEKIEDVGAVSHPKTNQNIHRKMVDALQHEMNLLKELHHENIVTYYGASQEGGNLNIFLEYVPGGSVSSMLNNYGPFEESLITNFTRQILIGVAYLHKKNIIHRDIKGANILIDIKGCVKITDFGISKKLSPLNKKQNKRASLQGSVFWMSPEVVKQTATTAKADIWSTGCVVIEMFTGKHPFPDFSQMQAIFKIGTNTTPEIPSWATSEGKNFLRKAFELDYQYRPSALELLQHPWLDAHII

SEQ ID NO: 67727 - protein, 130 aa, Saccharomyces cerevisiae
MTRSSVLADALNAINNAEKTGKRQVLLRPSSKVIIKFLQVMQKHGYIGEFEYIDDHRSGKIVVQLNGRLNKCGVISPRFNVKIGDIEKWTANLLPARQFGYVILTTSAGIMDHEEARRKHVSGKILGFVY

SEQ ID NO: 67728 - protein, 304 aa, Aspergillus nidulans FGSC A4
MLYLVGLGLADERDITVRGLEVVKKAERVYLEAYTAILLVDKAKLEAFYGRPVIEADRELVETGSDDILANADKVDVAFLVVGDPFGYAFYILDMVFDINSIRAFRATTHTDLVLRARELGIESKVIPNASIMSGIGCTGLQLYNFGQTVSMVFFTETWKPSSYYDRVKENVQIGLHTLVLLDIKVKEQSLENMARGRLIYEPPRFMTVAQCAAQMLETEEERQEGVWGPDSLAVGAARVGAEDQKLVAGTLQELTQVDMGRPLHSLVLLGRRAHDLEKDYIRRFAVDEATFDAAWQNGKYGSS

SEQ ID NO: 67729 - protein, 464 aa, Sulfitobacter sp. EE-36
MPSTVKKQPRKAAAKKPAKSSVVPDMLDANVSVETNAQLIARREQAVPRGVASAAPIYAKYAENAELWDVDGNRYIDFVGGIGVLNTGHRHPKVIAAAKAQEDQYTHTSFQVVPYAPYIELAEKLNALAPGDAPKKTLLVTTGAEAVENAVKIARAATGRPGVIAFTGGYHGRTLLTLGMTGKISPYKKDVGPFPSDIFRAPFPSPRDGITVEDAITGLKNLFLTDAQPERVAAIIIEPVLGEGGYTPVPFEMMHQLREICDQHGIMLIADEVQAGFGRTGKWFAIEHSGVTPDLITVAKSMAGGYPLAGVIGRADVMDAMIPGGLGGTYGGNPVACAAALAAIEAIEEEGLLQRSLDMGDHLKARFAEIGARSAPFRMWDIRGLGAMVAVEFVTDFDTATPDGDFTKRVIAHALKRGLLLLSCGMQGNAVRVMVPLTASDAIIEEGLGIFEASVAAAVAEEAK

SEQ ID NO: 67730 - protein, 886 aa, Medicago truncatula
MAPEPNRAGNGASTSGTAKDEAAAKKKIESEDLSDEDLALKQQLELYVERVQDTDPGLQKVALESMRQEIRTSTSSMTSVPKPLKFLRPHYGTLKAYYETMVESELKKYLADILSVLALTMSAEGERESLKYRLLGSEGDIGSWGHEYVRNLAGEIAQEYAKRQSEEAPIDDLMELVKQIVAFHMKHNAEPEAVDLLMEVEDLDMLTEHVDKTNFKRTCLYLTSSARYLPGPDDMLVLDIAFSIYLKFEEFPNALQIALFMDNLLHVRTVFTSCHDVLRKKQFCYILARHGITFELDEEMVNDDEEREVLQDIINNSKLSEGYLTLARDIEVMEPKSPEDIYKAHLLDGRASAGASVDSARQNLAATFVNAFVNAGFGQDKLMTVASDSSSSGSSGNWLFKNKEHGKTSAAASLGMILLWDVDSGLAQLDKYFHSNDNHVIAGALLGVGIVNCSIKNDCDPAMALLGDFIDKEDSSTRIGAIMGLGIAYAGSQNEQLRYKLAPILSDPKASLDVIAFTAIALGLIYVGSCNEEVAQAIIFTLMDRSESELGEPLTRLLPLGLGLLYLGKQESVEATAEVSKTFNEKIRKYCDMTLLSCAYAGTGNVLKVQNLLGHCSQHLDKGEMHQGPAVLGIAMVAMAEELGVEMAIRSLEHLLQYGEQNIRRAVPLALGLLCISNPKVNVMDTLSRLSHDTDSEVAMAAVISLGLIGAGTNNARIAGMLRNLSSYYYKDTSLLFCVRIAQGLVHLGKGLLTLNPYHSDRVLLSPTALAGLITMLHACLDMKAIVLGKYHYVLYFLVLAMQPRMLLTVDEDLKPLSVPVRVGQAVDVVGQAGRPKTITGFQTHSTPVLLAAGDRAELATEKYLPISPILEGFVILKDNPDYREE

SEQ ID NO: 67731 - protein, 214 aa, Pseudomonas fluorescens PfO-1
MHDLQDLIDNNERWADAITKEDPDFFAKLARQQTPEYLWIGCSDARVPANEIVGMLPGDLFVHRNVANVVLHTDLNCLSVIQYAVDVLKVKHILVTGHYGCGGVRASMQDRQFGLIDGWLRSIRDLYYEKREELARLPTEEEQVDRLCELNVIQQVANVAHTSIIQNAWHRGQSLSIHGCIYGIKDGRWKSLNTTISGFEQLPPQYRLRPVGAP

SEQ ID NO: 67732 - protein, 297 aa, Triticum aestivum
MEAVARASIAAGSHARVPLCRRPRPRHAVRCLRGRPSVACAAAADADVVRLFDAAKLTVDEFVKSGMVVGLGSGAASGLAVQYLGTRLRRGSLTGIVGIPSSVICASEAEKAGIKVGSHEEGAQIDFAFADADVIEEGTLAAVIGRGKTESGQPSFIQEKGIVESADKVAFIIDNDKYVNGIEGSIPVLVKSGNWIDTAEEIDDLFLGDAEVWRRPSIGTAGPSGGDFPLVTKEGHHILDVIFTTPIQDLGKVAEDLEKIVGVVDHGIICNTMPYAVIASKGEVQVLDRKSSVIPNT

SEQ ID NO: 67733 - protein, 393 aa, Arabidopsis thaliana
MPRSMSSDRLVQWDDDSNRPHKKLKHSTTISETSVIEDDADSSTQMGHSIKTIPKSDRWVVTRYLGNSSRSSVYLAESTIEGEEDYLPYEMTIKSIEISQASRLMNEEKFLSRLQNPVVVSFYGHEVTIEKDEKDPLLEKMYYNTLQEYSSGRNLATHIEKNRGKLPEDDVRSLANEILLGLKYIHEEKIIHCDIKPKNIILPFENNLFAQIAGFGKAIKKWSVEYGEGLGHRIGTSRLLPPEVMMDMVLDYGADVWAFGCTVLEMLTGERVWSEFGKLDWEGWKTLIGESGSVPYIPNYLSDKAKDFLAKCLERDPSKRWSVDSLLEHEFLKWIDEDEEEEIYEEEEDDFYDGIEDVDEEYEANLEAEAAVEEEEAIEIDEEYPKEESEDDH

SEQ ID NO: 67734 - protein, 114 aa, Triticum aestivum
HEIQYGGDNASASPRSQYPSQSTAPTVHIPNTSSQQPSPSLFAPGNPGLTQSKNSMVFSSALSSPIRRSLQPYHLEQGGDAGYFANGASRDVNPTASNDSSMDMHSDSPAHDSY

SEQ ID NO: 67735 - protein, 435 aa, Oceanobacillus iheyensis HTE831
MIIDTHPFTVNEKGHLEIGGLDTLDLAKKYGTPLYVYDVALIRNNARAFVQAFTEKGVKGKVAYASKAFSSIAMLQVAKQEGLCLDVISEGELYTALQAEFPTERIHMHGNNKSIEEIRMAVDYEIGCIVIDNFHDIDLLEKVLEEKQKQMDVLIRVTPGVESKTHQYIMTGNEDSKFGFDLQNGQAEQAFKRLHNHQQIRFQGLHCHIGSQIFETSGFQVATDLLFSELEKWNNKYDYQPNVLNLGGGFGIRYTKDDQPLPLDKYIKSMADAVQTHVKQLSMEMPEIWIEPGRSIVGNAGITLYTIGSNKQIPGIREYYSIDGGMTDNIRPALYNAAYEAVIANHPKNPIEKEVSIAGKCCESGDMLIWDLPVPEINSGDVLAVFSTGAYSYSMASHYNRLPNAAVVFVENGRDQLVVRRETYQDVVRNDLSYE

SEQ ID NO: 67736 - protein, 638 aa, Ostreococcus tauri
MRLSSFLPPLIVALVVLSHPLEVLAQVCRECDDATRPCASCTVDVTYVTEPLPVEANATTVEESLFLGSFVLKSVRPETLASWQVTWSFPDGQSLYNGVTDAVLINPGGPGGQPARVVNRLDATVDKAEQKFSFVGHAEDGQDVLGATRIRVNGVLCSQANAENIQVSFTDASCLVREWRFCCGSKIMPPSPSPPFPPPAPPLESLAPPVVVQRGALSSAAQSSTSWLRNGSTMSALVVACIISLVLTIEVCRRVRSFIAGEEAPLADLDLEDVFAPKRKNTLLLPGQCFKARSDDLEGIVVQDDDTARMNAGVLHRHDLFNASFATYVENAGDVIEETSTGEDVVEIQLSSIKLGRLLGRGAHGAVYAGKWNKRTVAVKKLHAMSSVPQNDLKTFVREVQVLSKIAHPKIVRMFGACLKQPHLCIVEEMMDGGSLHTLLHEDKRLTDLDDIARIAMDVALAMSYLHSEHIVHRDLKSHNVLLNSHGAKVADFGIARALEQTIGQTLGTKTNASGAIGGTPAYMAPECFHGDVEAVTTKCDVYSYSVLLWEMLSRRVPWEEYANHMQIIFAVAIQSQRLPLDVLGEDDVVTRTLVDKVMVPAWQTDPDARPDFHEVVDVLRKLLNDRVEARDAVMKEC

SEQ ID NO: 67737 - protein, 241 aa, Brassica napus
  misc_feature (107)..(107): Xaa can be any naturally occurring amino acid
  misc_feature (138)..(138): Xaa can be any naturally occurring amino acid
  unsure (1)..(241): unsure at all Xaa locations
MGSMSNPNPWSPYDSYNDCSQGVCNIYCPQWCYLIFPPPPPSFLDDEDEDSPSSFSPLLIALIVTLVTAFILVSYYTLVSKYCRRPSRETSSSELSGGVSSSSALAXGDGLNDALIKSITAYKYRKGDGHVHGSDCSXCLSEFEENESLRLLPKCNHAFHLPCIDTWLRSHSNCPLCRAFVTGINNPITQSNAVHPIATESVNRGGGGAAEVNLTAAGYDHRTGDSVVVVEDLEIGLRSQP

SEQ ID NO: 67738 - protein, 486 aa, Vibrio vulnificus YJ016
MEVTAHYIGGKPFVGDTGESFATLNPATGEVLAHIEQADERVLAHAIESAKLGFSVWSSMSAAERSRCLLKAAQLIRDHNDELAELEVRDTGKPIQEASVVDIATGADVIEYFAGLVNGLGGEQQSLGSNQFFYTRREPLGICAGIGAWNYPIQIAMWKAAPALAAGNAMIFKPSEETPLSALKLAELFTQAGVPDGVFNVVQGDYRVGQMLTAHPEIAKVSFTGESGTGKKVMADSAATLKPVTMELGGKSPLIIFDDADLDDAVSAAMVANFYTQGEVCTHGTRVYVQRAMYDAFVEQLKERTEKLIVGDPMNMETQIGSLISKSHLEKVLGAISSAKESGATLLTGGFQVTERGLEKGCFVAPTVFVDCRDEMPHVQNEIFGPVMSVLVFDDEDEVIARANNTQYGLAAGVFTQNLSKAHRVIHQLQAGICWINTWGNSPAEMPVGGYKLSGIGRENGQETLLHYTQTKSVFVELGAFDSPYA

SEQ ID NO: 67739 - protein, 395 aa, Ustilago maydis 521
MQNPFGLRSESAAVHEPILQDFAPQPPSTKLPWSTHEQRPVGLAIVYACCRVPQEDSIWHKHTHDSFFCIFYAGQPADSFLIHSHIPYLSLGNRLYHHRFHRHLVHDLAQERFWMYTAFPCSSLFSVARRHCNPFNVVSSRSFATTTRVDCSTHLASSFPATTRQSHSASSSTCTSSSKMQPVAQLVSKNKAWSADFLAKKPELAAHLAQRQTPKMLWFGCADSRVPETTICDAEPGDFFVSRNIANQFRLDDTAANALLTFAVQSVGIEHVCVVGHSSCGGVLAAIGGATTPPSEKDIESSALLQHLIPLFKLAKEVCEANPGLSNDELAFKVVSASVKQQIDNIISTSIIQDNWNGVTSPLSGKVMNKVQVHGLFYDIGKQELIDLDLSRSAP

SEQ ID NO: 67740 - protein, 447 aa, Burkholderia mallei ATCC 23344
MTSRDERLHRGLEERHINLMALGATIGVGLFLGSATAIRAAGPAILLTYILGGVAIFLIMRALGEMAIDNPVAGAFSRYARDYIGPLAGYLTGWTYWFMWIVTCMAEITAVGVYMHMWFPDVPNWIWTFAALIVMGAVNFIAVKLYGEFEFWFALIKIVTIVLMIAGGALMIVAGVGNGGVPTGVSNLWAYGGFLPNGWPGVVDALPIVMFAYLGVEMLGLTAGEARNPEKSLAKAVNSVFWRVVIFYVGALFVIMSVYPWNQIGTQGSPFVMTFSRLGIPAAAGIINFVVLTAALSSCNSGIFSTARMLFNLAEQGQAPERLASVNRRGVPVHGVLISVALLFVGVVLNYFAPQKVFVWLTSVSTFGAIWTWCVILIAQLRFRRRVSAERLARLPLRVPCYPLSSFVALAFLAFVVVLMAFSPDTRVALVIGPLWIAALTVYYYAS

SEQ ID NO: 67741 - protein, 456 aa, Magnetospirillum magnetotacticum MS-1
MPGMDGYELAELMRGEPRTAQVPIIFVTAAYSDDIHRNRGYDVGAVEYLQKPIDDFILRSKVRVFIDLFLSRRALEAELARTTAMSQVLRESEARLHHAVSEAPIPIMIHAEDGTVTLLSRVWSELTGYGPEDIPTIQDWTRRAYGERSEENLARIQASYGMSGPRAEGEREVITASGEVRVWDLRSAPIEALPDGRRLVISMAIDVTDRYHVQEELAGKTTELERSNADLEQFAYVASHDLREPLRMVNSFLGLLDKKFGSTLPDDAREYIAYAKDGAKRMDSLILDLLEYSRIGRKAVPDQAIDLKPTLDTALSNLALAVEESGATINTPDTMPKLCVDSGEFVRLFQNLIGNALKYRSPDRAPVVSITAEFKGNAWEFRIADNGIGIEPQYFDRVFQIFQRLHARTETSGTGIGLAICKRVVSRHRGRIWVESVPGEGSTFCFTIPAVKAGAA

SEQ ID NO: 67742 - protein, 289 aa, Anabaena variabilis ATCC 29413
MITGKTKLLGVIGHPVEHSLSPVMHNAAIAQLGLDYVYLPFPIAPDNLEAAIALLATIGVVGFSVTIPHKQAIIPLLAEISPVAQAIGAVNTVTRQNNQWVGTNTDIEGFIAPLQTTYKRDWSQQIAVILGNGGAARAVVAGCYQLGFAEIHVVGRNVQRLEEFRHSWDNSPIAENLQVHTWDYLAKLVPQANLLVNTTPIGMYPQVDESPLSTEELANLQTGAIAYDLIYIPKPTQFLQKAQQQGAIAIDGLEMLVQQGVAALKIWLQQDDIPVDVMRQALQKHLGLV

SEQ ID NO: 67743 - protein, 238 aa, Oryza sativa (japonica cultivar-group)
MAYYVINYSKLRIWEFVEYERMVYLDADIQVFDNIDHLFDLDKGAFYAVKDCFCEKTWSHTPQYDIGYCQQRPDEVAWPERELGPPPPLYFNAGMFVHEPGLGTAKDLLDALVVTPPTPFAEQDFLNMFFREQYKPIPNVYNLVLAMLWRHPENVDLDQVKVVHYCAAGSKPWRFTGKEENMNREDIKMLVKRWWDIYNDESLDYKEEEDNADEASQPMRTALAEAGAVKYFPAPSAA

SEQ ID NO: 67744 - protein, 125 aa, Oryza sativa
MAKTEQKACLIVIDGWGIPSAESPKDGDAITNANTPVMDEFAKSKTGYVELEASSLAVGLPEGLMGNSEVGHLNIGAGRVVWQDVVRIDQAVKTGSFATNEVIKKTMEVAKNGNGRLHLCGLVSH

SEQ ID NO: 67745 - protein, 429 aa, Sulfolobus tokodaii str. 7
MAIIDDARKGIITDEMKKISLIEKISPEKVRKRIVEGKIMLIRNEKYPSKKIVAIGKGLTTKVNINIGTSSEVVNLDMELEKVKIANKWGDTLMDLSTGGDLDLIRREIIKHSELPVGTVPVYQVFIESFKHKSGGAYFTEDDLLNTIEKHLKDGVAFMTIHAGLTKDLAIRALKSNRIIPIVSRGGDMIAGWMIHNNSENPYRKNWDYILEMFKQYDAVISLGDALRPGATGDAHDEFQIGELLETARLVKSALEKGVQVMVEGPGHVPLNEIAWDVKLMKKLTGGVPYYVLGPLPIDVGAPYDHIASAIGAAIASASGADLLCYLTPAEHLSLPTVEQVEEGAIAYRIAAHAGDIVKLGKKVRNWDDVVSYYRGKLEWEKMISSLIDPERAMKVYTQFGKPKVRACTMCGGYCPMMWAMEQVRKISD

SEQ ID NO: 67746 - protein, 241 aa, Triticum aestivum
NKFVQKSRLVPVRNSRDIVDPRVRVVVAPPFIYIDQVKSSLTDRIEVSAQNTWIGKGGAFTGEISAEQLVDIGCQWVILGHSERRHVIGEDDQFIGKKAAYALSQNLKVMACIGELLEEREAGKTFDVCFKQMKAFADNITDWKNVVIAYEPVWAIGTGKVASPEQAQEVHAAVRDWLKTNVSADVASTVRIIYGGSVNAANCAELAKKEDIDGFLVGGASLKGPDFATICNSVTSKKVTA

SEQ ID NO: 67747 - protein, 420 aa, Shewanella sp. MR-4
MSNVRYISNLTRETYALILAGGRGSRLHELTDWRAKPALYFGGKFRIIDFPLSNCINSGIRRVGVVTQYKSHSLIRHVMRGWGHFKKELGESVEILPASQRYSENWYQGTADAVFQNIDIIRHELPKYVMVLSGDHVYRMDYAGLLAAHAESGADMTVSCLEVPVAEAAGAFGVMEVDDEMRILGFEEKPKHPKHSPGNPEKCLASMGNYVFNTEFLFDQLKKDAQNANSDRDFGKDIIPSIIEKHKVFAYPFKSAFPNEQAYWRDVGTLDSFWQANMELLSPTPALNLYDAKWPIWTYQEQLPPAKFVFDDDDRRGMAVDSIISGGCIISGATVRRSVLFNEVRVCSYSVVEDSVVLPDVVVLRHCKIKNAIIDRGCIIPEGTVIGYNHDHDRAKGFRVSEKGITLVTRDMLGLPVGYE

SEQ ID NO: 67748 - protein, 395 aa, Oryza sativa
  misc_feature (240)..(240): Xaa can be any naturally occurring amino acid
  unsure (1)..(395): unsure at all Xaa locations
MTTRNGQIKNFTSNSGPQHPAAHGVSRSVLEMNGEVVERAEPHIGSLHRGTEKLIEYKTYLQALPYFDRSDYVSTMAQEHAHSSAVERLLNCEVPLRAQYIRVLFCEITRISNHSLASTTHAMDVGASTPFLWAFEEREKLLEFYERVPGARMHASFIRPGGVAQDLPLGLCRDIDSSTQQFASRIDELEEMSTGNRIWKQRLVDIGTVTAQQAKDWGFSGVMLRGPGVCWDSRRAAPYXDVYDQLDFDVPVGTRGDCYDRYCIRIEEMRQSVRIIVQCLNQMPSGMIKADDRKLCPPSRSRMKLSMESLIHHFELYTEGFSVPASSTYTAVEAPKGEFGVFLVSNGSNRPYRCKIRAPGFAHLQGLDFMSKHHMLADVVTIIGTQDIVFGEVDR

SEQ ID NO: 67749 - protein, 752 aa, Shewanella sp. MR-4
MTNPVPVNADGSTAYNLSAGQPFPLGATVDDGGVNFALFSAHATGVELCLFDAQGEVETQRIPLTEQTQQIWHLYVHGLSAGQLYGYRVYGPYEPQLGHRFNPHKLLLDPYARQLVGRYHHHIANFGYEIDNPNEDLSFSTLDNADFVPKCKVVDTRPLFDAAKAHTIRPLSSKREPLPLEQCIIYEMHLKGFTALHPEIDAPLRGTFAGLASNAAIDYLVNLGVNCVELLPVQAFFSEPFLLEKQLSNYWGYNSVGFFAPEPSYLSSEDIGEFRTMVDALHGAGIEVILDVVYNHSAEGSRLGPTFSFRGIDNLSYYRLHPNDKRFYINDTGCGNTLNLNHPRMLQLVLDSLRYWVEVMGVDGFRFDLAACLGREAYGFDPGSGFFDALLQDPVLCRVKLIAEPWDIGPGGYQLGNFPVAFSEWNDRYRDTMRRFWRGDHGMLPEFARRFHGSGDFFEHSGRPPAASINFLTSHDGFTLKDLVSYCERHNWANGEENRDGHHENFSHHYGVEGDTDDATILALRARQQRNLLTTLFLSQGVPMLLSGDETGRTQGGNNNAYCQDNPLNWFDWSSDGMDSSLLSFTSQLIALRKRFPLLCSKRFIHEQLVANAFDWSSESSSSHAVSPASTPTGARLDWFSRQGEPMSKSLWSESMGRSLCVVLSGNLTATQPQTQGDNLQALLLMVNADEHPLAFTLPVFDGLGPWQCLLHTQTDPQFLTPTEPLDAQSSPTRYLLQDRSLMLFHADFIRN

SEQ ID NO: 67750 - protein, 293 aa, Triticum aestivum
  misc_feature (222)..(222): Xaa can be any naturally occurring amino acid
  misc_feature (267)..(267): Xaa can be any naturally occurring amino acid
  unsure (1)..(293): unsure at all Xaa locations
LSAHPVFFCYKLYYLFTDVTHILSELEFIIQRVKVSTTPDGRVVNLFFITDGMELLHTKERQEEICSMLIATLGPSLTCEILSAEGFQQGFSSLPPTISEELFRLELDECESSSGPLSAEMKKVQKATINFDNSLSPAHTLLQILCVDQKGLLYDMLRTLKDCNIKVTYGRFWSDKKGFREVDLFIKQADGKKVIDPEKQDALRSRMRSEMLHPLRVMIVNXRGPDTELFVANPVELAGKGRPRVFYDATLALKALGICIFSAEIGXRQHRSANGRSTDSSWMTAKNFPCQTA

SEQ ID NO: 67751 - protein, 319 aa, Thermotoga maritima MSB8
MKKIAVLTSGGDAPGMNAAVRAVVRYGVRQGLEVIGVRRGYSGLIDGDFVKLEYKDVAGITEKGGTILRTSRCEEFKTEEGRELAAKQIKKHGIEGLVVIGGEGSLTGAHLLYEEHKIPVVGIPATIDNDIGLTDMCIGVDTCLNTVMDAVQKLKDTASSHERAFIVEVMGRHSGYIALMAGLVTGAEAIIVPEIPVDYSQLADRILEERRRGKINSIIIVAEGAASAYTVARHLEYRIGYETRITILGHVQRGGSPTAFDRRLALSMGVEAVDALLDGEVDVMIALQGNKFVRVPIMEALSTKKTIDKKLYEIAHMLS

SEQ ID NO: 67752 - protein, 809 aa, Burkholderia vietnamiensis G4
MQFPESWLRTFVDPQLTTDELSHALTMAGLEVESLSKAAPPTSKIVVGRVLEVVKHPDADKLNVCQVDAGTGATLNIVCGAPNVAPGIKVPVALVGAELPPAEEGGKPFAIKLSKLRGVESQGMLCSARELKLSEDHSGLLILPEDTPVGQDIRDTLNLDDTIFEIKLTPNKADCLSVFGIARETAAITGAPLTPIDIKPAHVELDETLPVRIAAPDLCGRFSGRVIRGVNARAKTPQWMVERLERAGQRSVSALVDISNYVMFELGRPSHVFDLDKIHGGIEVRWGKRGESLKLLNGNTVELDETVGVIADDRQVESLAGIMGGDSTAVTLDTTNIYLEAAFWWPDSIRGRARKYNFSTDAAHRFERGVDYATTVEHVERITQLILEICGGKAGPVDDQAVNLPQRAPVKMRVSRANRIIGVKIDADEIANIFTRLGLPFERDDDAFLVTPPSHRFDIEIEEDLIEEVARIYGFEKIPARPPVATSEMRATNETQRSIHDIRHALAARDYAETVNFSFVDAEWEHDFAGNDNPIRLLNPIASQLSVMRTTLFGSLISVLRHNLNRRADRVRVFEAGRVFLTDPSAKAGELTVEGYSQPKRVGALAYGPALDEQWGVATRAVDFFDVKGDLEALLAPAVARFVKAEHPALHPGRSARIEIDGCAVGWIGELHPRLMQKYELPHAPVMFEIDTEALMARALPAPTDVSKFPPVRRDIAVVVDQAVEVQALFDEMKKALAEDACRFVQKVVLFDEFRAKSNTSGGLAAHEKSLAFRVTLQDAAGTLQDEVVDQAIHTLVERMARVGARLRG

SEQ ID NO: 67753 - protein, 603 aa, Arabidopsis thaliana
MAASSTNARLTNPPRLLSKPRLSPTSVANLRFPAADFSTRFFADSSSPRLRSVPFPVVFSDQRRRRSMEPSNVYVASNSTEMEIGSHDIVKNPSLICAPVMADSIDKMVIETSKAHELGADLVEIRLDWLKDFNPLEDLKTIIKKSPLPTLFTYRPKWEGGQYEGDENERRDVLRLAMELGADYIDVELQVASEFIKSIDGKKPGKFKVIVSSHNYQNTPSVEDLDGLVARIQQTGADIVKIATTAVDIADVARMFHITSKAQVPTIGLVMGERGLMSRILCSKFGGYLTFGTLDSSKVSAPGQPTIKDLLDLYNFRRIGPDTKVYGIIGKPVSHSKSPIVHNQAFKSVDFNGVYVHLLVDNLVSFLQAYSSSDFAGFSCTIPHKEAALQCCDEVDPLAKSIGAVNTILRRKSDGKLLGYNTDCIGSISAIEDGLRSSGDPSSVPSSSSPLASKTVVVIGAGGAGKALAYGAKEKGAKVVIANRTYERALELAEAIGGKALSLTDLDNYHPEDGMVLANTTSMGMQPNVEETPISKDALKHYALVFDAVYTPRITRQLREAEESGAITVSGSEMFVRQAYEQFEIFTGLPAPKELYWQIMSKY

SEQ ID NO: 67754 - protein, 804 aa, Vibrio vulnificus YJ016
MPIPTKAAMFLEKDMQKNTLWFNSLSMEDVDKVGGKNASLGEMVSNLANAGVSVPNGFATTSYAFNQFLDYEGLDERIHQLLDELDVDDVDALRKTGATIRQWVLEAPFPADLEQDIRENYSTLTDGNDEISVAVRSSATAEDLPDASFAGQQETFLNVRGIDAVLEATKHVYASLFNDRAISYRVHQGFDHRGIALSAGIQRMVRSDKAASGVMFTLDTESGFDKVVFITSAWGLGEMVVQGAVNPDEFYVHKPLLEAGQAPIVKKTFGSKLSKMIYANSQVIGKQVEIVDTSEAERNQFSLTDAEIVELAKQAMIIEKHYQRPMDIEWAKDGIDGQLYIVQARPETVCSQSDANVIERYELSHKAEVLIEGRAIGQRIGSGVVRLVDSLDQMSLVQTGDVLVTDMTDPDWEPVMKKASAIVTNRGGRTCHAAIIARELGIPAIVGCGNATSQLTDGDLVTVSCAEGETGYVYQGQLDFEVRRSSVDELPMLPTKVMMNVGNPDRAFDFAQIPNEGVGLARLEFIINKMIGIHPKALLNFDQQSESLKAEISQRIRGYQDPIDFYVSKLTEGIATIASAFWPKRVIVRMSDFKSNEYSNLVGGKAYEPHEENPMLGFRGASRYISPVFEDCFELETQAIKRVRNEMGLKNVEIMIPFVRTPSEAAQVVDLLAKFDLRRGEQGLKVIMMCELPSNAVLADEFLKYFDGFSIGSNDMTQLTLGLDRDSGDVAHLFDERNPAVKAMLKMAIDAATKAGKYVGICGQGPSDHEDFAEWLMEQGISSVSLNPDTVIDTWIQLGKANQK

SEQ ID NO: 67755 - protein, 663 aa, Debaryomyces hansenii CBS767
MLEGEFQASVKLTYKTSSQTTTDIAGQVNPKLVYDPCDNDIPIAQVYGKMKPTPEILKNSDLLQLVSEWVAKFSKVLEDISESPTSNINELDSIFAPHSFWKDHLCLSWDFHQYSDLGQIKDFLSKQIPYFQLQNFQINRTADLRYDNSISIATIQDSTGEQPIPIQLVQFIVNFDNCYGKGSGVIRLIPVDNKLIAYSVYTGLESIKGNEEQLGFNRPEGVNHGQHKARTSWLENREKDFIWGDSSKQPTVLVVGGGQSGLNIAARLKCMGVDTLIVEKNPNIGDNWRNRYKFLVLHDPVWADHLAYMNFPDTWPIFTPKDKLGDWFENYAKNMELSFWANKTVVGADFEEDKSTWIVKVIDNDSGKMDTLRPKHVIMATGHSGEPNIPSFEDQHKFKGKIVHSSQHSTGKMYQGENALVVGCCNSGHDIAQDFYEQGAKPILVQRSSTCIFTAEVGGEITNEGLYEEGGPPIDTADLLSQSMPWKLLNLTLQQQTRRIVSLEKELHDSLKNVGFNIDYGYGGTGLPGKYSRRGGGYYIDVGCSRLIAERKILVKNGQSIHKFTEDGVVFSDGSTIGNVAIVVLATGYSNMKESARKIFGSTVADRLNPVWGLDDEGETKVMYRDSGHPNFWYMGGNLLLTRYFSKKLALRIIAQERDFIKD

SEQ ID NO: 67756 - protein, 128 aa, Thermotoga maritima MSB8
MKRFVETDKAPKAIGPYSQAVVVGNMMFVSGQIPIDPETGELVQGTIEEKTERVLENLKAILEAGGFSLKDVVKVTVFTTSMDYFQRVNEVYSRYFGDHRPARSFVAVAQLPRNVEIEIEAIAVKEGE

SEQ ID NO: 67757 - protein, 454 aa, Populus sieboldii x Populus grandidentata
DLNHRNLTDLAKKFGDILLLRMGQRNLVVVSSPDLAKEVLHTQGVEFGSRTRNVVFDIFTGKGQDMVFTVYGEHWRKMRRIMTVPFFTNKVVQQYRHGWEEEAAQVVEDVKKNPEAATHGIVLRRRLQLMMYNNMYRIMFDRRFESEEDPLFNKLKALNGERSRLAQSFDYNYGDFIPILRPFLRGYLKICKEVKERRLQLFKDYFVEERKKLGSTKSMSNEGLKCAIDHILDAQKKGEINEDNVLYIVENINVAAIETTLWSIEWGIAELVNHPEIQKKLRDELDTVLGPGHQITEPDTYKLPYLNAVIKETLRLRMAIPLLVPHMNLHDAKLGGFDIPAESKILVNAWWLANNPAKWKNPEEFRPERFFEEEAKVEANGNDFRYLPFGVGRRSCPGIILALPILGITLGRLVQNFELLPPPGQSKIDTSEKGGQFSLHILKHSTIVAKPRSF

SEQ ID NO: 67758 - protein, 382 aa, Oryza sativa (japonica cultivar-group)
MAFALTRSSAMKTSLCVLLCILVISEVVGVPRCAAALGINYGQVGNNLPSPAQVVSLLASLRIGKVRIYDANPQVLAAFAGTGIELIVTVPNDLVRPMAASPGEALQWVSSSVRPYFPATRVTGIAVGNEVLTDDDEALKAALVPAMRNLHAALAQLGMDGYVHVSTASSLAVLATSYPPSQGAFTAEVAPLMAQFLRFLAETNAPFWINAYPYFAYKGDPTRVSLDYALSNPYHVGAIDPYTRLQYTSMLYAQVDAVAYATSQLGYNNIPVYVSETGWPSKGDTDEVGATVENARAYNRNLLLRQAAGEGTPLRPRQRLEVYLFALFNENMKPGPTSERNYGLYQPDGRTMVYNVGLMQQSTSAASLSLAASPATKTVSAH

SEQ ID NO: 67759 - protein, 394 aa, Oryza sativa (japonica cultivar-group)
MASPPAKKVLVPIASGTEPMEAVITVDVLRRAGADVSVASVDPGSAQVGGAWGVKLAADALLDDLADAEFDLISLPGGMPGSSNLRDCKLLENMVKKHAGKGKLYAAICAAPAVALGSWGLLNGLKATCYPSFMDKLPSEVNAVESRVQIDGNCVTSRGPGTAMEYSVVLVEQLYGKEKADEVAGPMVMRPQHGVEFSLKELNSTSWNVGETPQILVPIANGTEEMEATMIIDILRRAKANVVVASLEETLEIVASRKVKMVADVLLDDALKQQYDLILLPGGLGGAQAYAKSDKLIGLIKKQAEANKLYGAICASPAIALEPHGLLKGKKATSFPGMWNKLSDQSECKNRVVVDGNLITSQGPGTSMEFSLAIVEKLFGRERAVELAKTMVFM

SEQ ID NO: 67760 - protein, 566 aa, Citrus x paradisi
MSPSLVANADLSPVTSGTVKGRVASVYSELQTSRIDHALPLPSVLKNPFKIVDGPASSAAGNPDEIAKLFPNLFGQPSALLVPNGADAVRSDEKLKIGVVLSGGQAPGGHNVISGIYDYLQDRAKGSVLYGFRGGPAGIMKCKYVELTSNYIYPYRNQGGFDMICSGRDKIETPEQFKQATETAVKLDLDGLVVIGGDDSNTNACLLAEHFRSKNLKTLVMGCPKTIDGDLKCKEVPASFGFDTACKIYAEMIGNVMIDARSTGKYYHFVRLMGRAASHITLECALQTHPNITIIGEEVAAKKQTLKNVTDYIVDIICKRAELGYNYGVILIPEGLIDFIPEVQQLIAELNEILAHEVVDEGGQWKKKLTKQSLQLFEFLPQAIQEQLMLERDPHGNVQVAKIETEKMLIQMVETELENRKQEGVNKGQFKGQSHFFGYEGRCGLPTNFDATYCYALGYGAGALLHSGKTGLISSVGNLAAPVEEWTVSGTALTALMDVERRHGKFKPVIKKAMVELDGTPFKKFVSMRDEWALNNRYISPGPIQFTGPTSGDVNHTLLLELGAQV

SEQ ID NO: 67761 - protein, 168 aa, Avena sterilis subsp. ludoviciana
VMASSATSVAPFQGLKSTAGLPVSRRSNAGLGSVSNGGRIRCMQVWPIEGIKKFETLSYLPPLTEEALLKQIDFLIRSKWVPCLEFSQGGFIFREHGSTPGYYDGRYWTMWKLPMFGCTDASQVIKEVEEVKKEYPDAYVRIIGFDNIRQVQCVSFIAFKPPGCEESG

SEQ ID NO: 67762 - protein, 427 aa, Torulaspora delbrueckii
MATHEEFIRTQVFGTVFEITNRYTDLNPVGMGAFGLVCSATDTLAQQPVAIKKIMKPFSTAVLAKRTYRELKLLKHLRHENLICLQDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYDVEVDIWSAGCIFAEMTEGKPLFPGKDHVHQFSIITDLLGSPPEDVINTICSENTLKFVTSLPHRDPVPFRERFKTVEPEAVDLLEKMLVFDPKKRITAADALVHPYLAPYHDPTDEPVADAKFDWNFNDADLPVDTWRVMMYSEILDFHKIGGGDGQIDTSATFDDQVAAATAAAAHAAAVAQAQAQAHSNSSNSNSSSNVNSKSKAARDSANDAITNYGNQAVHYANEFQQ

SEQ ID NO: 67763 - protein, 151 aa, Xylella fastidiosa Dixon
MLRLLALERAPIQCTFIFHRLHIQMSFQIIHTEKAPAAIGPYSQAVRVGNTVYFSGQIPLDPATGTIVAGDLAVQARRAFDNLRAVAETANGSLSKIVRLGLYLTDLEQFSVVNAVMQEYFQDPFPARSTIQVSGLPKGADFEVDAVMVID

SEQ ID NO: 67764 - protein, 436 aa, Marinobacter sp. ELB17
MSNNTNHLLDDAQSRMADIYERLEVADDSRHRLGQPKRIHQASLSVRMDDGSLRVFPAWRVQYDDTRGPTKGGIRFHPNVTEDEVATLSLWMTLKCAAVDLPFGGAKGGICVDPKTLSRLELERLSRGYIRAFHDVIGPDRDIPAPDVNTNAIVMGWMVDEYAQIARRHVPGVITGKPLGLGGSIGREEATGAGALQVLDLWAKRQNKEPHELSVAIQGFGNAGQNFARLAHHAGYKIVALSDSQGAIYNEDGLDPEPILRHKNRTRELKGMVYCGDSVCDAAETETQTLSGDELLQLDVDVLVLAALENQITDANADHIRAKTIVEIANGPISTGGDQILQGRDITVIPDIVANAGGVIVSHLEWVQNRMGDYWSGDTVEKQLRQRLEREANACFDLADEKAVPLRTAAYLQGVRRIVDAMAQQGTQGYFNDRRG

SEQ ID NO: 67765 - protein, 145 aa, Glycine max
  misc_feature (90)..(90): Xaa can be any naturally occurring amino acid
  unsure (1)..(145): unsure at all Xaa locations
MLLGKRPRPPIMKRTTSMSEITFDLNTTLDDDPNNPVKGPGGNQNRVWAMVSPRNHSEDTTPDFLRVCFLCKRRLVPARDIFMYKVSINXNYCRGDSAFCSSECREQLMKQDERKDKYRVGSKKQVAEKPNSGSQVNKGETVVAL

SEQ ID NO: 67766 - protein, 144 aa, Hordeum vulgare subsp. vulgare
MPTAGLAAGSNKVDVAIDLGNPLLNRTVDGFLKIGAVGACRVVAEDAFDCLHRGDISKRQLEETLKKMCKEGAYWGAVAGVYVGMEYGVERVRGDRDWKNALIGGIATGALVSAASNNKGNKIAQDAITGGAIATAVEFINYLT

SEQ ID NO: 67767 - protein, 358 aa, Oryza sativa (indica cultivar-group)
MSAYCGKYKDELIKNAAYIGTPGKGILAADESTGTIGKRFASINVENVEENRRSLRELLFCTPGALQYLSGVILFEETLYQKTKDGKLFVDVLKEGGVLPGIKVDKGTIEVAGTEKETTTQGHDDLGKRCAKYYEAGARFAKWRAVLKIGPNEPSQLAIDLNAQGLARYAIICQENGLVPIVEPEILVDGPHDIDRCAYVSEVVLAACYKALNEHHVLLEGTLLKPNMVTPGSDAKKVSPEVIAEYTVRTLQRTVPAAVPAIVFLSGGQSEEEATLNLNAMNKLSTKKPWSLSFSFGRALQQSTLKAWSGKAENIEKARAAFLTRCKANSEATLGTYKGDAVLGEGASESLHVKDYKY

SEQ ID NO: 67768 - protein, 744 aa, Burkholderia vietnamiensis G4
MTESASASSVAAPSFDDVLAFVRERAGAARLSTGELLADHSAGTASIMRTLNVDPHAMQAAALFVLTPHLSDPERELTERFGEEVARLVADVRKLLRLGTVSLRAAQNAMPDAGRDAAQQRRTQIEALRKMLLAFAQDIRVVLIRLASRLQSLRYYAAAKADPPPDVARETLEIYAPLANRLGIWQLKWELEDLAFRFEDPVTYKRIAKLLDEKRIEREAYVAQAIERLQHELAQAHIPADVSGRPKHIYSIWRKMRGKELDFSELYDVRAFRVIVPDIKDCYTVLGIVHHLWQPVPKEFDDYISRPKPNGYKSLHTVVIGDDGRAFEVQIRTQEMHRFAEYGVAAHWRYKEAGVRGYGGQFSASDKYDEKIAWLRQLLAWKDDVEDGGEVSGDQAWAQLRETSLDDDHIYVLTPQARVIALPQGATPVDFAYHLHSELGHRCRGARVDGAMVPLNTSLANGQTVEIVAVKEGGPSRDWLNPQLGYLKSSRARQKVRAWFNSIEQEENIAHGRALVEKTLQREGKTSVNLDNLAAKLGFKSPDDLFSVVGKEEFSLRNIEQALSDAPPPEHAPEAPADFEKRSSGASVAHGASTGVLVVGVDALLTQLARCCRPAPPDPISGFVTRGKGMSIHRSDCPTFVRMAERAPERVLQTTWSADVLGGRGASVYPVDLMIEASDRQGLLRDISEVFAREKMNVVGVKTQSRRNTAFMQFTVEVSNAAQVQRACTLLGEVQGVVRAGRKA

SEQ ID NO: 67769 - protein, 399 aa, Oryza sativa (indica cultivar-group)
MFAAICRRRLAALFPQIRGGGGGAYHVQSNPQAALLFHGYSTAAVTGGPDSEPCPDTVSYLVSCGLPPAVARHTAANTRGLRIRSTEKADAVRTLLRSYGFSDADVARIARSAPLLLTVDPDRIIRPKLEFFATMGFQPSKLSTAPLLLARSLEKHLVPTIQFLRSIIGSDDGIRRGFSRIPRALMVSLDNCMRPAVEALHRHGLTGREDVSKVLVLQMGVLMLSPVRIGEIFEDLKAMGMSITDGRFANSFRAMCSMRRATWLRRVALYRSFGLSESEVFEAFKKQPTALLGADETIKKKASFFRDALKLEMREVMVHPVVMAYSFEKTILPRCAVLSVLMREGKINPDIQLLHALLGSAKTFSGRYVDRFAADVPDVVEAYEGKIKFKGFKGQGQGV

SEQ ID NO: 67770 - protein, 376 aa, Brassica napus
MGWIPCSGKSSGKTKKRSDSDENLSRNCSVSASERSKAKSSVSESRSRGSDNIVAQTFTFSELATATRNFRKECLIGEGGFGRVYKGYLASTGQTAAIKQLDHNGLQGNREFLVEVLMLSLLHHPNLVNLIGYCADGDQRLLVYEYMPLGSLEDHLHDISPSKQPLDWNTRMKIAAGAAKGLEYLHDKTMPPVIYRDLKCSNILLGDDYFPKLSDFGLAKLGPVGDKSHVSTRVMGTYGYCAPEYAMTGQLTLKSDVYSFGVVLLEIITGRKAIDNSRCTGEQNLVAWARPLFKDRRKFSQMADPMIQGQYPPRGLYQALAVAAMCVQEQPNLRPVIADVVTALTYLASQRFDPMSQPVQGSLFGPGTPPRSKRVV

SEQ ID NO: 67771 - protein, 162 aa, Malassezia pachydermatis
MSNVFFDITKNGSPLDPIKFKLFDDVVPKTTANFRALCTGEKGFGYAGSHFHRVIPNFMLQGGDFTAGNGTGGKSIYGAKFADENFQLKHSKPGLLSMANAGPNTNGSQFFITTVVAPWLDGKHVVFGEVIEGMDVVKAIEAEGSNSGKTSSRIEIAKCGAC

SEQ ID NO: 67772 - protein, 335 aa, Legionella pneumophila str. Lens
MNFFMMPHDLAQYAIVADIGGTFARFSRVNLVNLQMDKIEVSPCAEFISLESALLTYKNRHSLQEIKHIAIAIACPVIDDLVSMTNCHWQFSITELKQRLGLEVLEVMNDFTAIAMSLPVLSTQDLVQIGNGYLDASKVKVVLGAGTGLGVAYLIPHQHHYSAFAGEGGHADWGAKTEQEWFIYRYLKSKYSHVSYERLLSGQGLENLYQALAAYHSKKVEFLSAAQIISLALNQECFIAHKAVAQFFSSLGSFAGDLALTYGAFGGVYIAGGIMPRLLSLVHQSDFRIQFEDKGRFSDFNALIPTYVIAASQPGILGASVSLKQILTGASHVHF

SEQ ID NO: 67773 - protein, 253 aa, Zea mays
MGRKFFVGGNWKCNGTTDQVEKIVKTLNEGQVPPSDVVEVVVSPPYVFLPVVKSQLRQEFHVAAQNCWVKKGGAFTGEVSAEMLVNLGVPWVILGHSERRALLGESNEFVGDKVAYALSQGLKVIACVGETLEQREAGSTMDVVAAQTKAIAEKIKDWSNVVVAYEPVWAIGTGKVATPAQAQEVHASLRDWLKTNASPEVAESTRIIYGGSVTAANCKELAAQPDVDGFLVGGASLKPEFIDIINAATVKSA

SEQ ID NO: 67774 - protein, 116 aa, Triticum aestivum
VLPLATSLGFELATPFPQWHRRGLPVFQGSEHLLRTDPEDGLEGFFIALFVRKAGPTSEEPSEDATVEVRTKQVRGRRNGGQAFSSLRLSKDDPLVTKGVLGFNLMYHCYFWESMW

SEQ ID NO: 67775 - protein, 473 aa, Legionella pneumophila str. Lens
MAWIVAIIGSIAGFLFGYDEGIIAGSLGLVKNHFNLNATHIGVMASALPFGALFGSLLIGAFMASKCVKRFGRRSLLSFAGFLFFVGALGAGFAETISVLILSRLILGLAIGMASVLTPLYLAETAAVQSRGAVVAIYQLALTVGIVCSYSVNYLLIEQQAWRAMFASSAIPALLLSLGILFMPESPRWLCSVGRHDAAANSLRKLRGKQSVEQELKEIEATLANEPKQGNWLLLFQKPLLPVLMLGTILFCLQQLSGINVVIYFAPEIFKNLGLGSTTGQILATMGIGLVNLLVTIIAILYVDKLGRRKLLLLGFAGTSLSLFALSLFSLNHVAWLSYLSVICLMVYIFSFAISVGPIPHIAMAEIFPLHVRGAGMGMSSMSNWSFNTIVIFSFPVLHQMFGIEMTFVLYAVICFLGFIYAYIYMPETRNISLEQIETYIMSGKPLRFLGREDEEVNAVSTKSESSLLASTN

SEQ ID NO: 67776 - protein, 500 aa, Vitis vinifera
MAVGGFAADDNSRAFSGKVTASVVITCIVAASGGLIFGYDIGISGGVTTMQPFLKKFFPVVLRKAADAKTNIYCVYDSHVLTAFTSSLYIAGLAASLVASRLTRAVGRRNTMIIGGLTFLIGAALNGGAENVAMLILGRILLGFGVGFTNQATPIYLSEMAPPKWRGAFGTSFQFFIGIGVVVANCLNYGTAKISWGWRLSLGLAIVPSVIMTVGALLISDTPSSLVERGKVAQARDSLRKARGKDIDIEPELAELVKTSEAVKAANEEPFVTIFERQYRPHLVMAFAIPFFQQLTGINIIAFYAPVLFQSVGFGSDSALIASIILGCVNLLSIIVSTFIVDRYGRRILFLEGGTQMIIGQVAVACVLAVTTGVSGTKDIPRGYAVLVLVLMCIYAAGFGWSWGPLSWLIPSEIFPMKIRTTGQAISVAVNFATTFVLAQTFLTMLCHFKYGTFLFYAGWLIAMTLFVILFVPETKGIPLESMYQVWERHWFWRRFVSLP

SEQ ID NO: 67777 - protein, 549 aa, Shewanella oneidensis MR-1
MTLASIRRGYHVIKTLLQYGLDDVLPPKMTPWYFTLARNSLFWIRNKHKDKSGGERLKLAMQELGPVYIKLGQMLSTRRDLLSDEWATELAMLQDKVPPFDGALARLAIEAELKAPIETFFDDFNETPLASASISQVHTATLKSNGKAVVLKVLRPNVETKIQADLLLMSQTAKVIDYLLGEGNRLRPAEVIEDYRVTILGELNLKLEALNAIKLRNNFIDSDALYIPYVYEEFCYPRLMVMERIYGIPVSDIVALKAQGTNFKLLAERGVELFFTQVFRDNFFHADMHPGNIFISRENPENPYYIGLDCGIMGTLSEVDKRYLAENFLAFFNRDYHRIAQLYIESGWVSEKTDLQAFEQAIKVVCEPMFNKPLDEISFGHVLLELFRTARHFDIVVQPQLVLLEKTLLYIEGLGRQLYPQLDLWQTAKPFLEQWMAEQVGPKAMFKKVSTKLPYWSDKLPEFPELIYDNLKLGRKLLSSQQQMLDKYLKYQQQAHKSNYLLITSAILLICGTLLFNQDATLLSPYVCLISGAVLWIIGWRSRPKNRKF

SEQ ID NO: 67778 - protein, 447 aa, Salmonella enterica subsp. enterica serovar Typhi str. CT18
MDQTCSLESFLNHVQKRDPHQTEFAQAVREVMTTLWPFLEQNPRYRHMSLLERLVEPERVIQFRVVWLDDKNQVQVNRAWRVQFNSAIGPYKGGMRFHPSVNLSILKFLGFEQTFKNALTTLPMGGGKGGSDFDPKGKSEGEVMRFCQALMTELYRHLGPDTDVPAGDIGVGGREVGFMAGMMRKLSNNSACVFTGKGLSFGGSLIRPEATGYGLVYFTEAMLKRHGLGFEGMRVAVSGSGNVAQYAIEKAMAFGARVVTASDSSGTVVDESGFTPEKLARLCEIKASRDGRVADYAREFGLTYLEGQQPWSVPVDIALPCATQNELDVDAARVLIANGVKAVAEGANMPTTIEATDLFLEAGVLFAPGKAANAGGVATSGLEMAQNAARLSWKAEKVDARLHHIMLDIHHACVKYGGDNKHTNYVQGANIAGFVKVADAMLAQGVI
